US012569549B2

(12) United States Patent
Baumhof et al.

(10) Patent No.: US 12,569,549 B2
(45) Date of Patent: Mar. 10, 2026

(54) FLAVIVIRUS VACCINE

(71) Applicants: CureVac SE, Tübingen (DE); Sanofi Pasteur, Lyons (FR)

(72) Inventors: Patrick Baumhof, Tübingen (DE); Wolfgang Grosse, Tübingen (DE); Edith Jasny, Tübingen (DE); Thomas Kramps, Tübingen (DE); Daniel Voss, Tübingen (DE); Julia Dannenmaier, Tübingen (DE); Valérie Lecouturier, Chazay d'Azergues (FR); Yves Girerd-Chambaz, Messimy (FR)

(73) Assignees: CureVac SE, Tübingen (DE); Sanofi Pasteur, Lyons (FR)

( * ) Notice: Subject to any disclaimer, the term of this patent is extended or adjusted under 35 U.S.C. 154(b) by 0 days.

(21) Appl. No.: 18/403,883

(22) Filed: Jan. 4, 2024

(65) Prior Publication Data

US 2024/0131142 A1 Apr. 25, 2024

Related U.S. Application Data

(62) Division of application No. 16/772,131, filed as application No. PCT/EP2018/084607 on Dec. 12, 2018, now Pat. No. 11,931,406.

(30) Foreign Application Priority Data

Dec. 13, 2017 (EP) .................................... 17207141

(51) Int. Cl.
*A61K 39/12* (2006.01)
*A61P 31/14* (2006.01)
*A61K 39/00* (2006.01)

(52) U.S. Cl.
CPC .............. *A61K 39/12* (2013.01); *A61P 31/14* (2018.01); *A61K 2039/53* (2013.01); *A61K 2039/575* (2013.01); *A61K 2039/6031* (2013.01); *C12N 2770/24134* (2013.01)

(58) Field of Classification Search
None
See application file for complete search history.

(56) References Cited

U.S. PATENT DOCUMENTS

| | | | |
|---|---|---|---|
| 8,691,961 B1 | 4/2014 | Puffer et al. | |
| 2005/0032730 A1 | 2/2005 | von der Mülbe et al. | |
| 2005/0059624 A1 | 3/2005 | Hoerr et al. | |
| 2005/0250723 A1 | 11/2005 | Hoerr et al. | |
| 2006/0188490 A1 | 8/2006 | Hoerr et al. | |
| 2008/0025944 A1 | 1/2008 | Hoerr et al. | |
| 2008/0267873 A1 | 10/2008 | Hoerr et al. | |
| 2009/0324584 A1 | 12/2009 | Hoerr et al. | |
| 2010/0048883 A1 | 2/2010 | Ketterer et al. | |
| 2010/0189729 A1 | 7/2010 | Hoerr et al. | |
| 2010/0203076 A1 | 8/2010 | Fotin-Mleczek et al. | |

| | | | |
|---|---|---|---|
| 2010/0291156 A1 | 11/2010 | Barner et al. | |
| 2010/0305196 A1 | 12/2010 | Probst et al. | |
| 2011/0053891 A1 | 3/2011 | Baumhof et al. | |
| 2011/0250225 A1 | 10/2011 | Fotin-Mleczek et al. | |
| 2012/0021043 A1 | 1/2012 | Kramps et al. | |
| 2012/0095075 A1 | 4/2012 | Manoharan et al. | |
| 2012/0258046 A1 | 10/2012 | Mutzke | |
| 2012/0328649 A1* | 12/2012 | Falkner .................. A61K 39/12 |
| | | | 435/235.1 |
| 2013/0129754 A1 | 5/2013 | Thess et al. | |
| 2013/0142818 A1 | 6/2013 | Baumhof et al. | |
| 2013/0259879 A1 | 10/2013 | Baumhof et al. | |
| 2013/0280283 A1 | 10/2013 | Lorenz et al. | |
| 2013/0295043 A1 | 11/2013 | Kallen et al. | |
| 2013/0336998 A1 | 12/2013 | Kallen et al. | |
| 2015/0037326 A1 | 2/2015 | Butler-Ransohoff et al. | |
| 2015/0050302 A1 | 2/2015 | Thess | |

(Continued)

FOREIGN PATENT DOCUMENTS

| | | |
|---|---|---|
| WO | WO 2013/120499 | 8/2013 |
| WO | WO 2016/210127 | 12/2016 |

(Continued)

OTHER PUBLICATIONS

Chahal et al., "An RNA nanoparticle vaccine against Zika virus elicits antibody and CD8+ T cell responses in a mouse model," *Scientific Reports*, 7(1):252, 2017.

Hsieh et al., "A strong endoplasmic reticulum retention signal in the stem-anchor region of envelope glycoprotein of dengue virus type 2 affects the production of virus-like particles," Virology, 374:338-350, 2008.

Khalil et al., "A tetravalent alphavirus-vector based dengue vaccine provides effective immunity in an early life mouse model," *Vaccine*, 32(32):4068-4074, 2014.

(Continued)

*Primary Examiner* — Stacy B Chen
(74) *Attorney, Agent, or Firm* — pH IP Law

(57) ABSTRACT

The present invention is directed to an artificial nucleic acid and to a polypeptide suitable for use in the treatment or prophylaxis of an infection with a flavivirus, in particular an infection with yellow fever virus or with dengue virus, or of a disorder related to such an infection. The present invention is also directed to a composition, preferably an immunogenic composition, comprising the artificial nucleic acid or the inventive polypeptide. In particular, the present invention concerns an immunogenic composition against a flavivirus, such as yellow fever virus or dengue virus. Further, the invention concerns a kit, particularly a kit of parts, comprising the artificial nucleic acid, polypeptide or (immunogenic) composition. The invention is further directed to a method of treating or preventing a disorder or a disease, first and second medical uses of the artificial nucleic acid, polypeptide, composition, in particular the first and second medical uses of the immunogenic composition according to the invention.

19 Claims, 54 Drawing Sheets

Specification includes a Sequence Listing.

(56) References Cited

U.S. PATENT DOCUMENTS

| | | |
|---|---|---|
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2015/0329598 A1 | 11/2015 | Lu et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | von der Mülbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2017/0340724 A1 | 11/2017 | Ciaramella et al. |
| 2017/0354729 A1 | 12/2017 | Liu et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0358314 A1 | 11/2019 | Weissman et al. |
| 2019/0374633 A1 | 12/2019 | Graham et al. |
| 2019/0381180 A1 | 12/2019 | Baumhof et al. |
| 2020/0023076 A1 | 1/2020 | Fotin-Mleczek et al. |
| 2020/0085852 A1 | 3/2020 | Fotin-Mleczek |
| 2020/0085944 A1 | 3/2020 | Heidenreich et al. |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0318097 A1 | 10/2020 | Funkner et al. |
| 2020/0392572 A1 | 12/2020 | Yazdan Panah et al. |
| 2021/0030864 A1 | 2/2021 | Petsch et al. |
| 2021/0069315 A1 | 3/2021 | Baumhof et al. |
| 2021/0162037 A1 | 6/2021 | Jasny et al. |
| 2021/0170017 A1 | 6/2021 | Lutz et al. |
| 2021/0180106 A1 | 6/2021 | Wochner et al. |
| 2021/0205434 A1 | 7/2021 | Petsch et al. |
| 2021/0260178 A1 | 8/2021 | Jasny et al. |
| 2021/0261897 A1 | 8/2021 | Yazdan Panah et al. |
| 2021/0361761 A1 | 11/2021 | Lutz et al. |
| 2021/0379181 A1 | 12/2021 | Rauch et al. |
| 2021/0403925 A1 | 12/2021 | Chevessier-Tünnesen et al. |
| 2022/0040281 A1 | 2/2022 | Schwendt et al. |
| 2022/0073962 A1 | 3/2022 | Schwenger et al. |

FOREIGN PATENT DOCUMENTS

| | | | |
|---|---|---|---|
| WO | WO 2017/015463 | 1/2017 | |
| WO | WO 2017/070624 | 4/2017 | |
| WO | WO-2017081082 A2 * | 5/2017 | ............ A61K 39/12 |
| WO | WO 2018/211038 | 11/2018 | |
| WO | WO 2019/077001 | 4/2019 | |
| WO | WO 2019/092153 | 5/2019 | |
| WO | WO 2020/123300 | 6/2020 | |
| WO | WO 2020/161342 | 8/2020 | |
| WO | WO 2020/254535 | 12/2020 | |
| WO | WO 2021/028439 | 2/2021 | |
| WO | WO 2021/211343 | 10/2021 | |
| WO | WO 2021/239880 | 12/2021 | |

OTHER PUBLICATIONS

Koraka et al., "Bioinformatics in New Generation Flavivirus Vaccines", J. Biomed. Biotechnol., 9(5):864029, 2010.

Office Action issued in U.S. Appl. No. 16/772,131, mailed Feb. 22, 2023.

Office Action issued in U.S. Appl. No. 16/772,131, mailed Jul. 13, 2023.

Office Action issued in U.S. Appl. No. 16/772,131, mailed Jun. 6, 2022.

Office Action issued in U.S. Appl. No. 16/772,131, mailed Jan. 28, 2022.

Office Action issued in U.S. Appl. No. 16/772,131, mailed Oct. 11, 2022.

Pardi et al., "Zika virus protection by a single low-dose nucleoside-modified mRNA vaccination," Nature, 543(7644):248-251, 2017.

Patkar et al., "Functional requirements of the yellow fever virus capsid protein," Journal of Virology, 81(12):6471-6481, 2007.

PCT International Search Report and Written Opinion issued in International Application No. PCT/EP2018/084607, mailed Apr. 2, 2019.

Ramanathan et al., "Development of a novel DNA SynConTM tetravalent dengue vaccine that elicits immune responses against four serotypes," Vaccine, 27(46):6444-6453, 2009.

Rouvinski et al., "Covalently linked dengue virus envelope glycoprotein dimers reduce exposure of the immunodominant fusion loop epitope," Nature Communications, 8:15411, 2017.

Shang et al., "Dengue virus-like particles: construction and application," Appl. Microbiol. Biotechnol., 94:39-46, 2012.

Smouse et al., "Identification of linear B-cell epitopes in the capsid, NS4a and domain III region in the E glycoprotein of yellow fever virus," International Journal of Infectious Diseases, p. 326, Abstract No. 57.032, 2014.

Ulmer et al., "Recent innovations in mRNA vaccines," Current Opinion in Immunology, 41:18-22, 2016.

White et al., "An Alphavirus Vector-Based Tetravalent Dengue Vaccine Induces a Rapid and Protective Immune Response in Macaques That Differs Qualitatively from Immunity Induced by Live Virus Infection," Journal of Virology, 87(6):3409-3424, 2013.

* cited by examiner

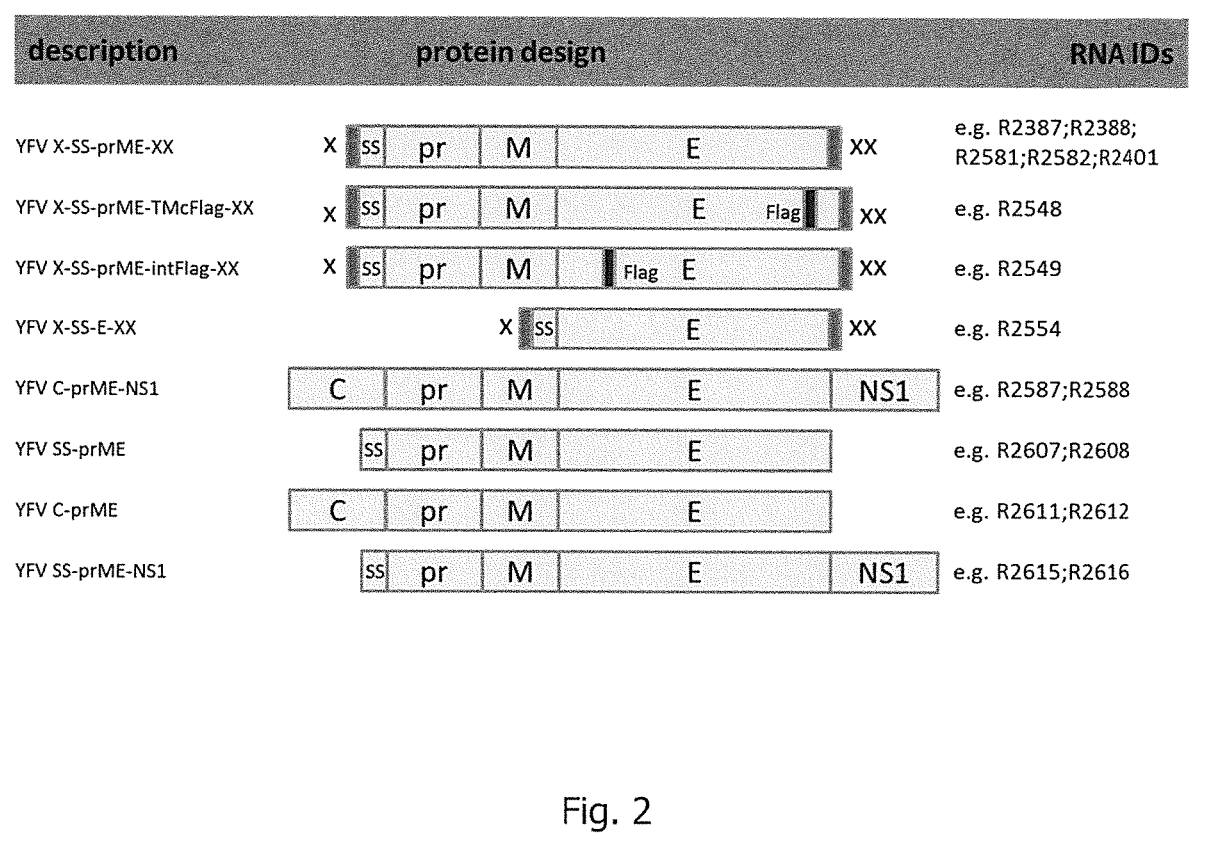

| description | protein design | RNA IDs |
|---|---|---|
| YFV X-SS-prME-XX | X SS pr M E XX | e.g. R2387;R2388; R2581;R2582;R2401 |
| YFV X-SS-prME-TMcFlag-XX | X SS pr M E Flag XX | e.g. R2548 |
| YFV X-SS-prME-intFlag-XX | X SS pr M Flag E XX | e.g. R2549 |
| YFV X-SS-E-XX | X SS E XX | e.g. R2554 |
| YFV C-prME-NS1 | C pr M E NS1 | e.g. R2587;R2588 |
| YFV SS-prME | SS pr M E | e.g. R2607;R2608 |
| YFV C-prME | C pr M E | e.g. R2611;R2612 |
| YFV SS-prME-NS1 | SS pr M E NS1 | e.g. R2615;R2616 |

Fig. 2

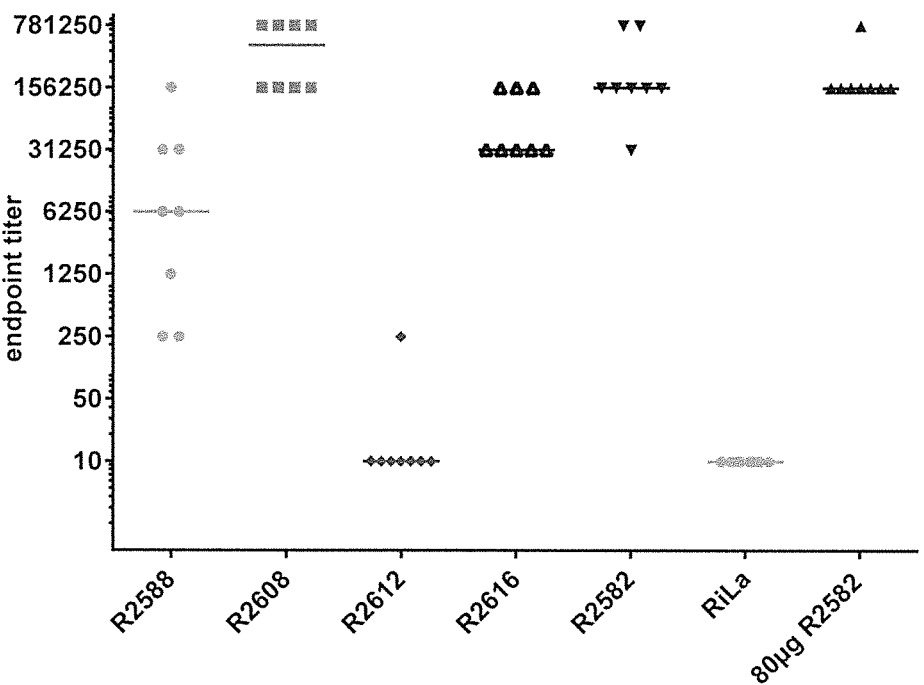
IgG2a endpoint titer
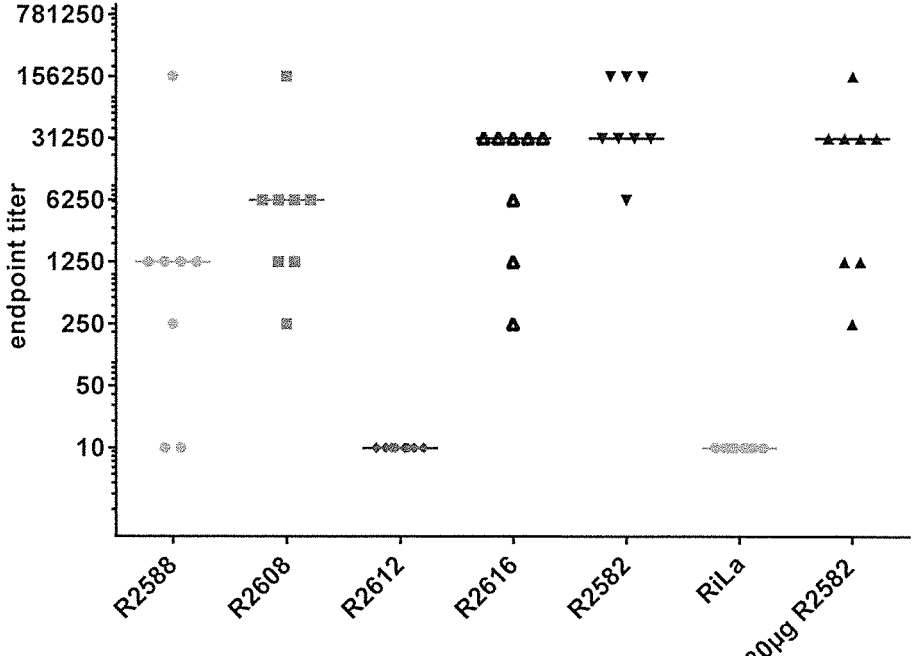
IgG1 endpoint titer
Fig. 5

A)
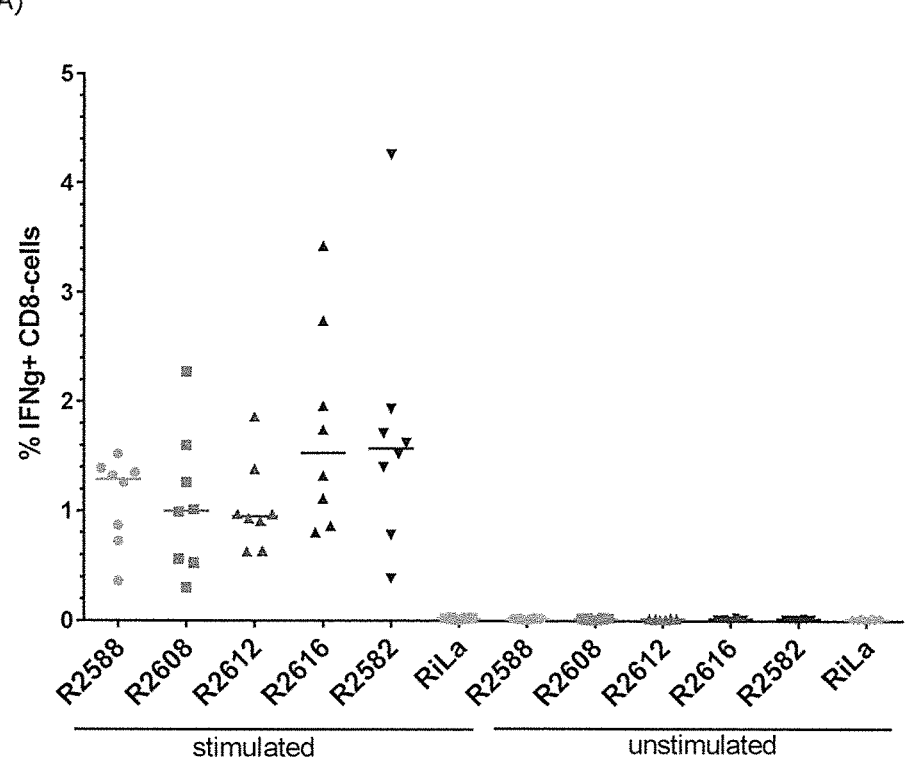
B)
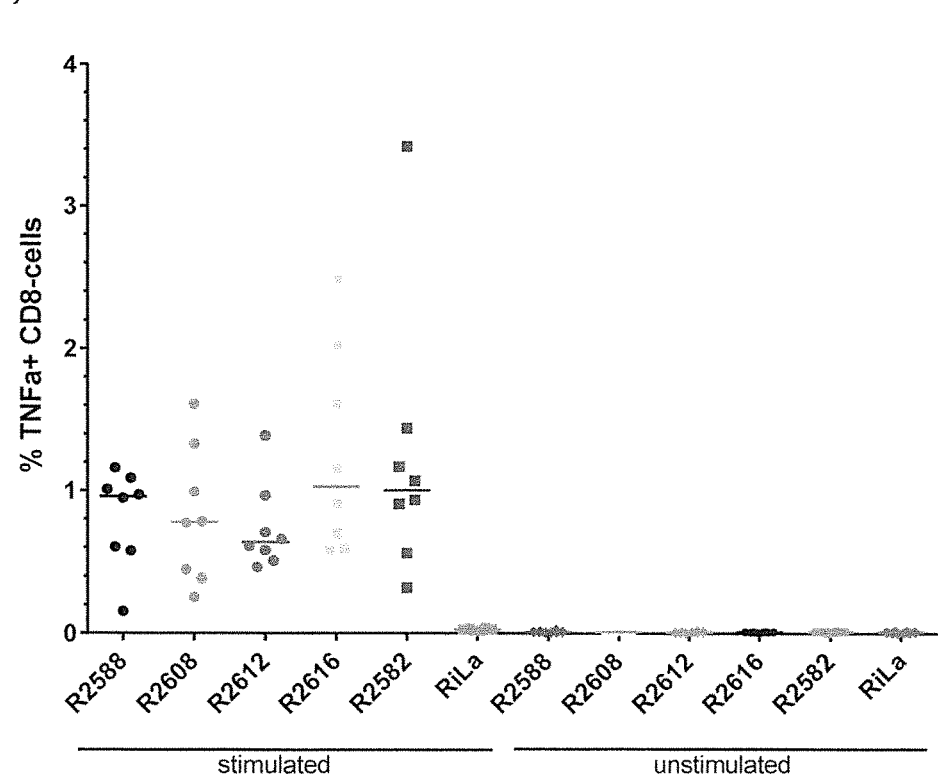
Fig. 6

C)
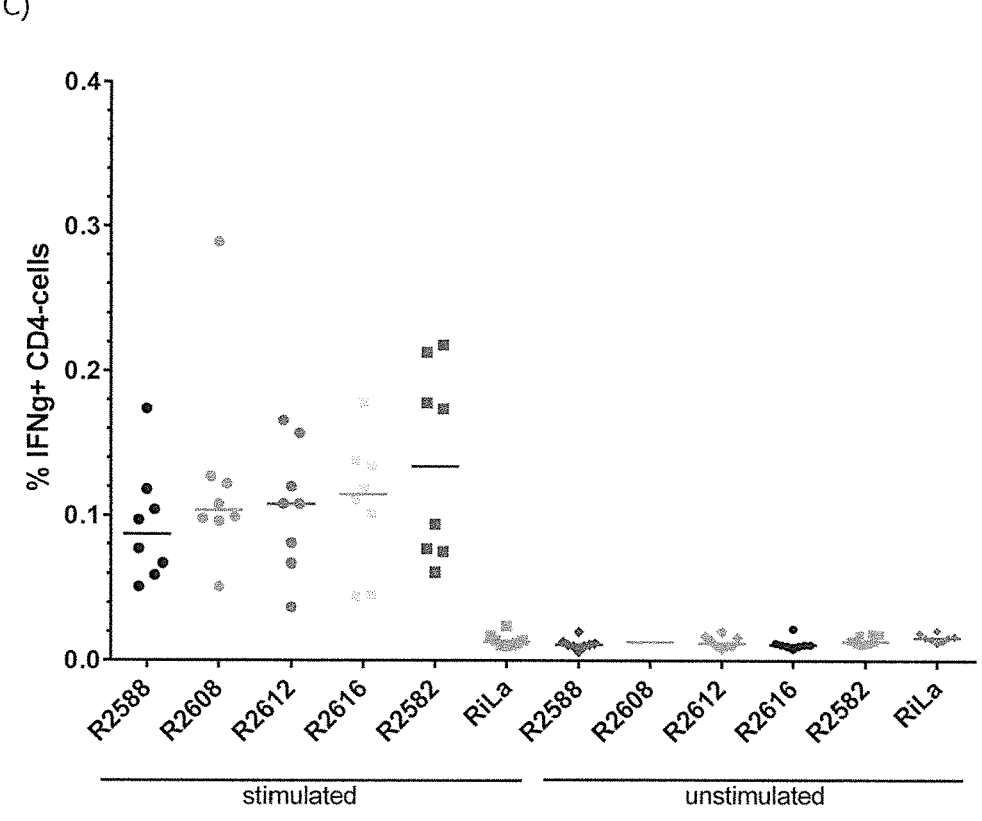
D)
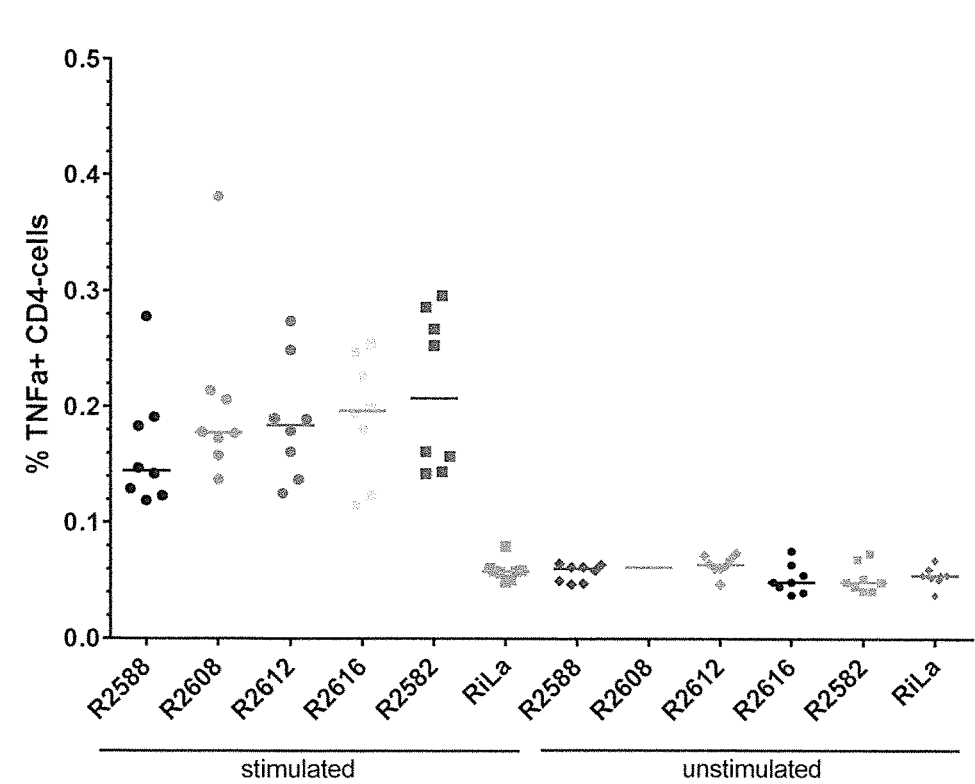
Fig. 6 (continued)

*= titer > 60

A
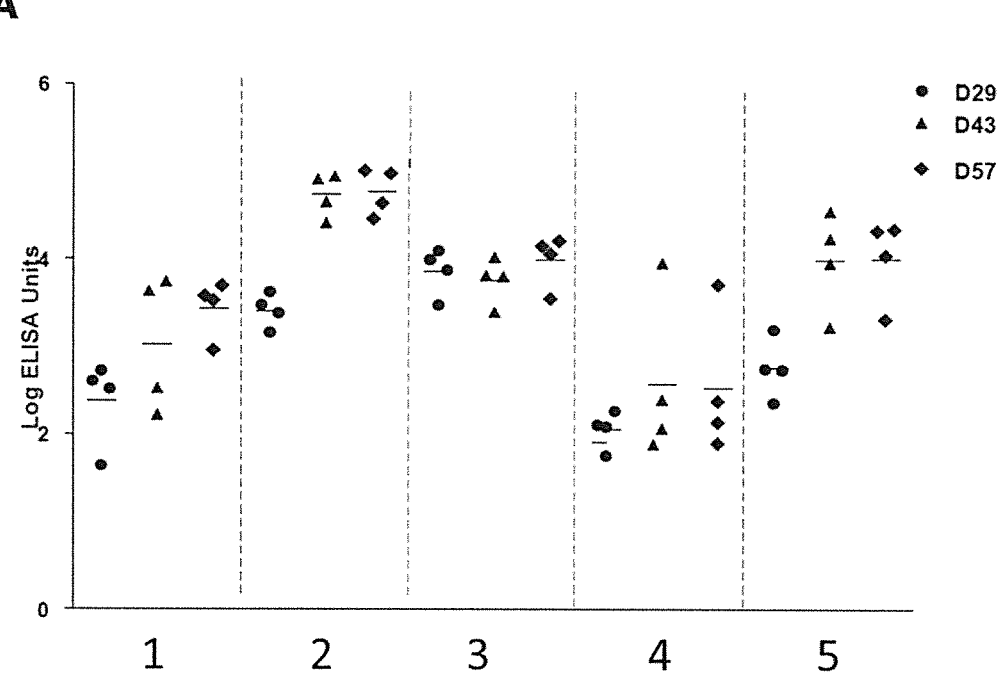
B
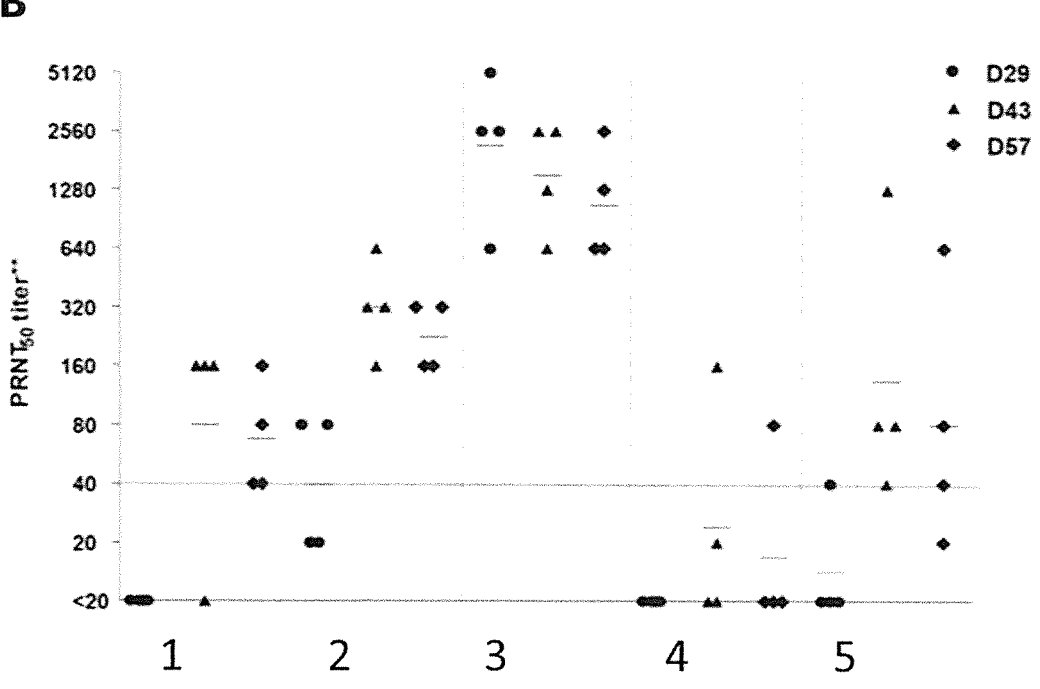
Fig. 10

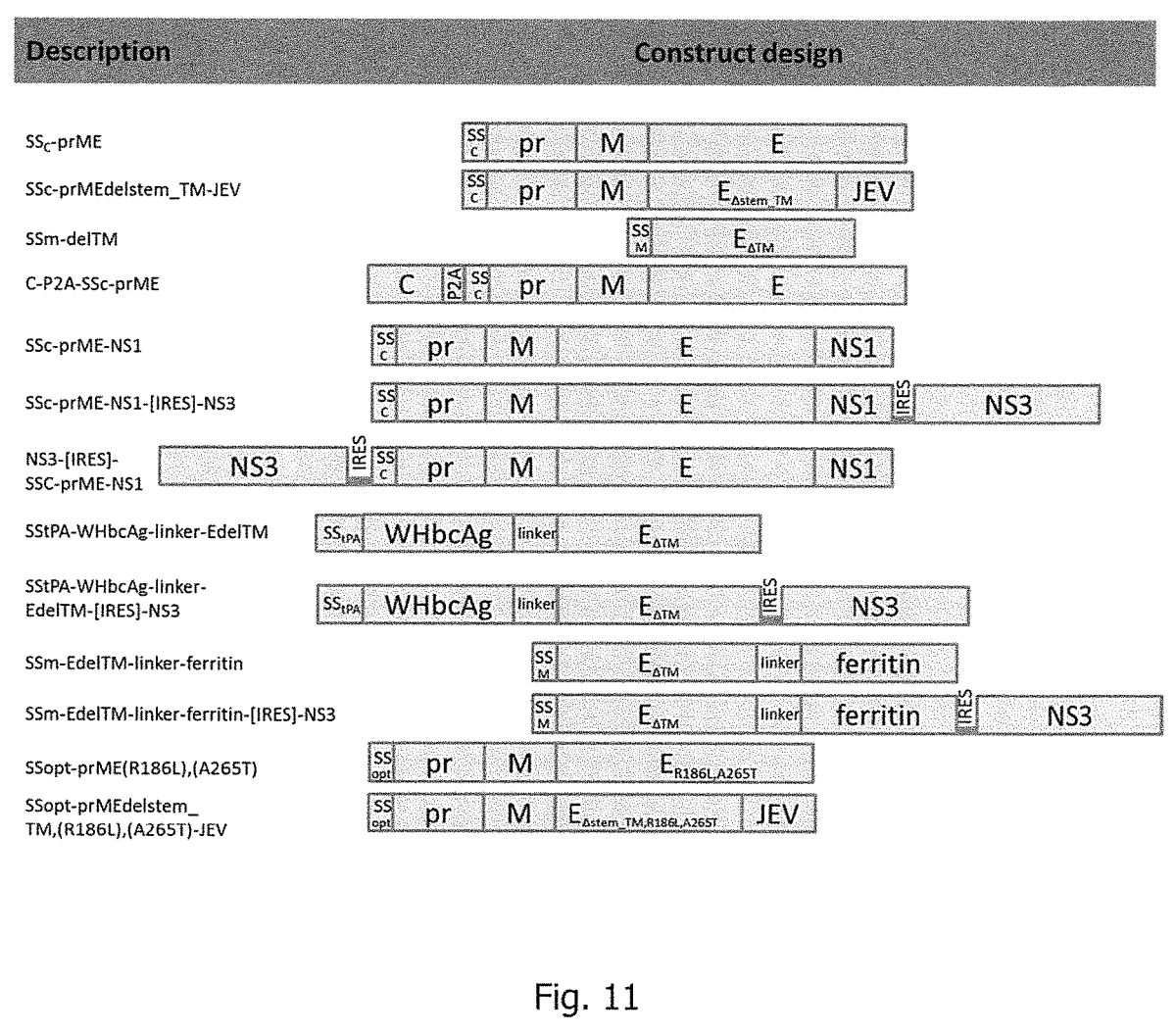

| Description | Construct design |
|---|---|
| SS$_C$-prME | SS$_C$ \| pr \| M \| E |
| SSc-prMEdelstem_TM-JEV | SS$_C$ \| pr \| M \| E$_{\Delta stem\_TM}$ \| JEV |
| SSm-delTM | SS$_M$ \| E$_{\Delta TM}$ |
| C-P2A-SSc-prME | C \| P2A \| SS$_C$ \| pr \| M \| E |
| SSc-prME-NS1 | SS$_C$ \| pr \| M \| E \| NS1 |
| SSc-prME-NS1-[IRES]-NS3 | SS$_C$ \| pr \| M \| E \| NS1 \| IRES \| NS3 |
| NS3-[IRES]-SSC-prME-NS1 | NS3 \| IRES \| SS$_C$ \| pr \| M \| E \| NS1 |
| SStPA-WHbcAg-linker-EdelTM | SS$_{tPA}$ \| WHbcAg \| linker \| E$_{\Delta TM}$ |
| SStPA-WHbcAg-linker-EdelTM-[IRES]-NS3 | SS$_{tPA}$ \| WHbcAg \| linker \| E$_{\Delta TM}$ \| IRES \| NS3 |
| SSm-EdelTM-linker-ferritin | SS$_M$ \| E$_{\Delta TM}$ \| linker \| ferritin |
| SSm-EdelTM-linker-ferritin-[IRES]-NS3 | SS$_M$ \| E$_{\Delta TM}$ \| linker \| ferritin \| IRES \| NS3 |
| SSopt-prME(R186L),(A265T) | SS$_{opt}$ \| pr \| M \| E$_{R186L,A265T}$ |
| SSopt-prMEdelstem_TM,(R186L),(A265T)-JEV | SS$_{opt}$ \| pr \| M \| E$_{\Delta stem\_TM,R186L,A265T}$ \| JEV |

Fig. 11

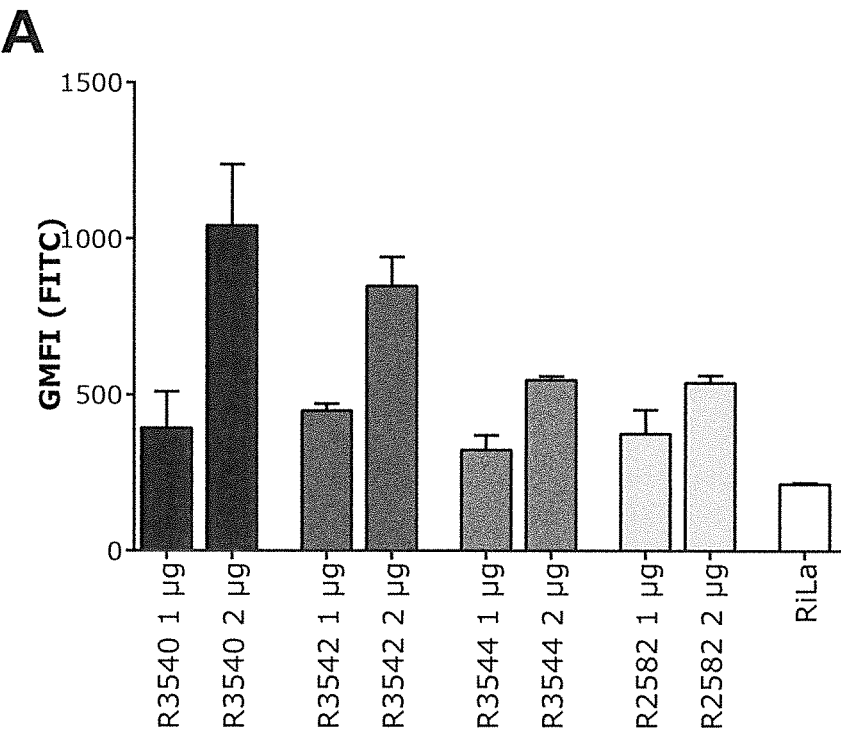
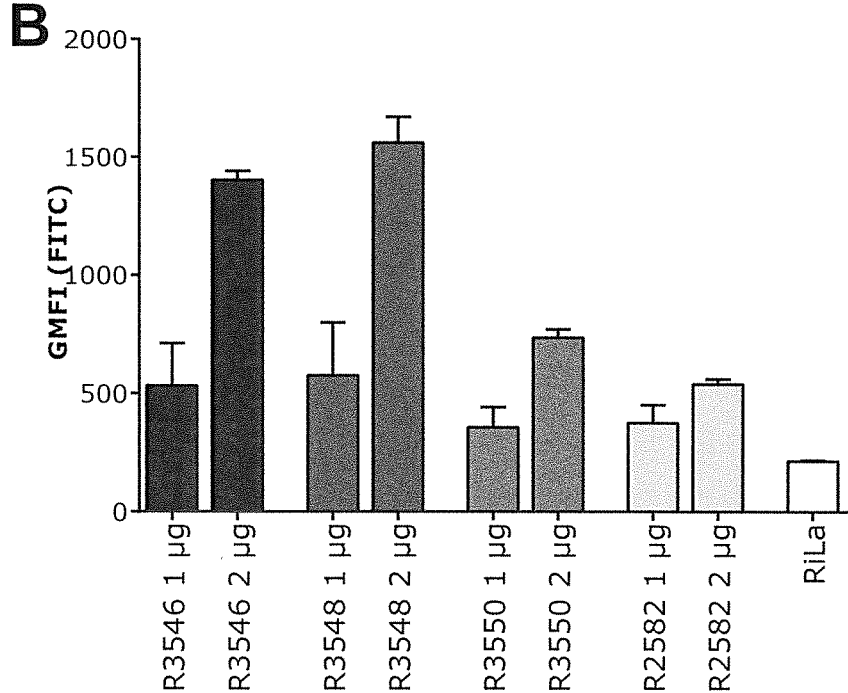
Fig. 12

Fig. 13 (continued)

| DENV serotype | R# | intracellular FACS analysis | Western blot | | |
|---|---|---|---|---|---|
| | | | cell lysates | supernatants | VLP preparation |
| DENV1 | R3540 | ++ | ++ | ++ | ++ |
| | R3542 | ++ | ++ | +++ | +++ |
| | R3544 | + | + | - | - |
| DENv2 | R3546 | ++ | ++ | ++ | ++ |
| | R3548 | ++ | ++ | +++ | +++ |
| | R3550 | + | + | - | - |
| DENV3 | R3552 | ++ | ++ | ++ | ++ |
| | R3554 | ++ | ++ | +++ | +++ |
| | R3556 | + | + | + | - |
| DENV4 | R3558 | ++ | ++ | ++ | ++ |
| | R3560 | ++ | ++ | ++ | ++ |
| | R3562 | ++ | ++ | +++ | +++ |
| | R3564 | + | + | - | - |

Fig. 14

A)
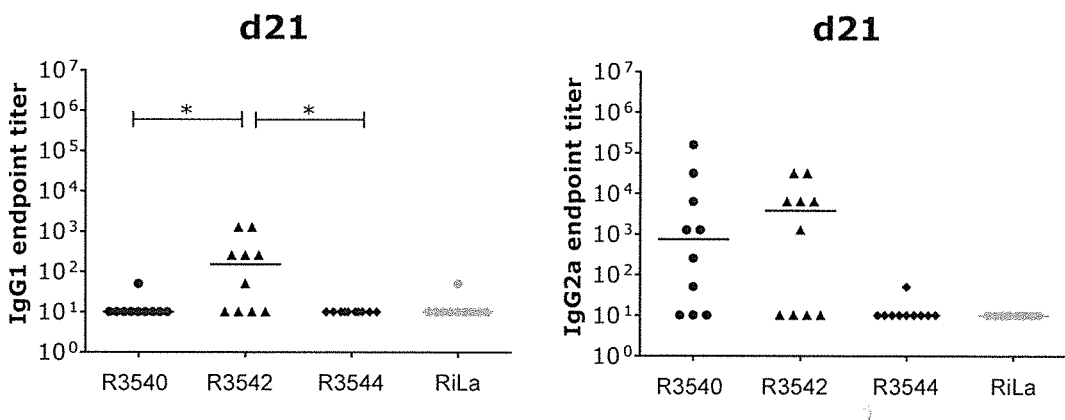
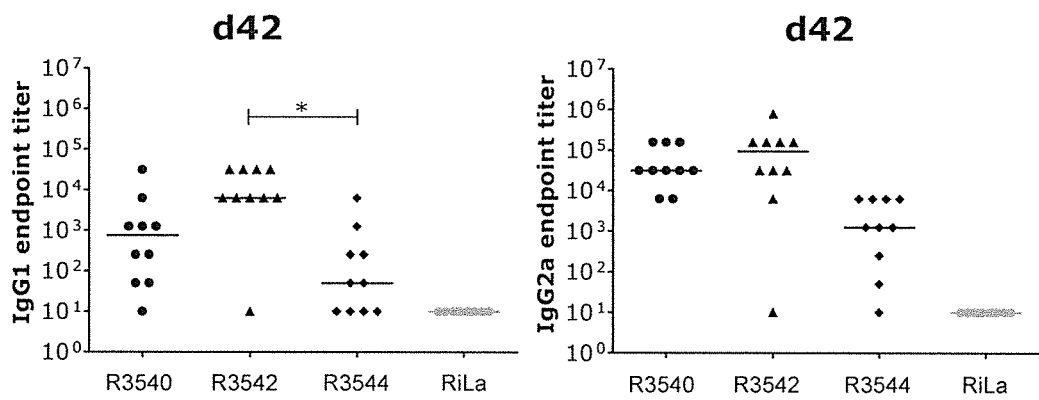
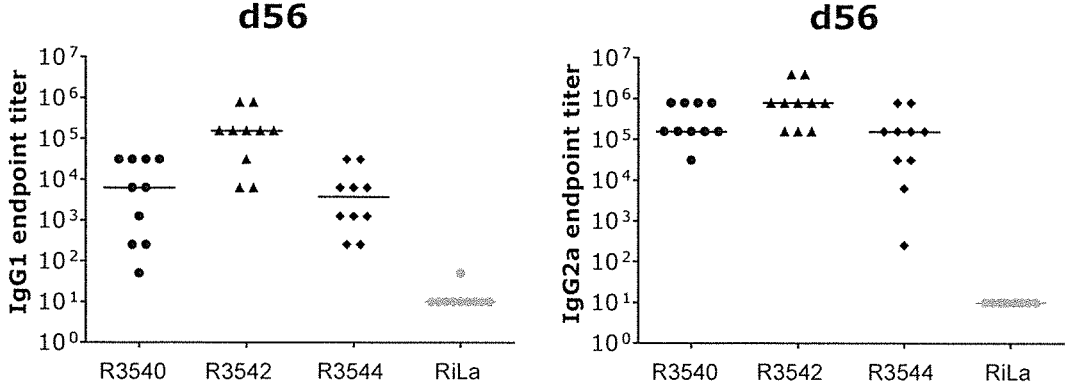
Fig. 15

B)
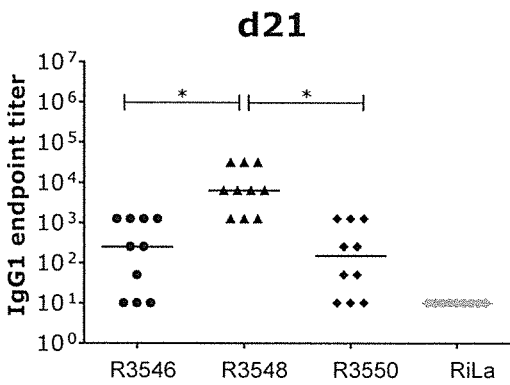
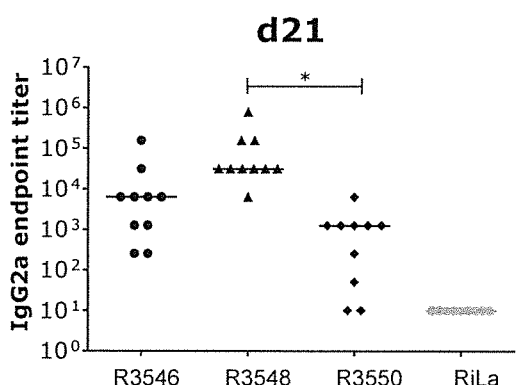
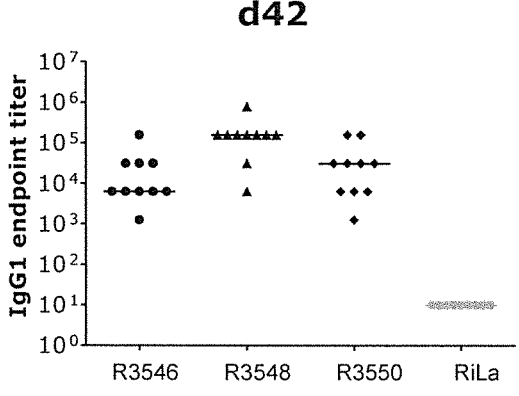
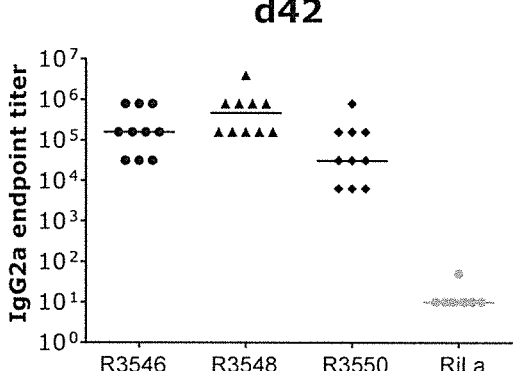
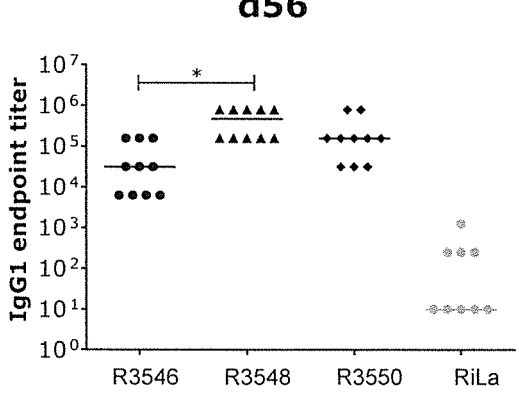
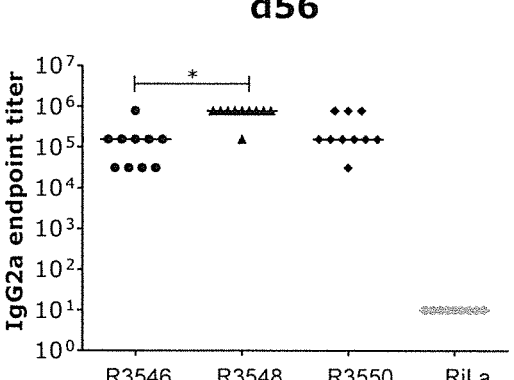
Fig. 15 (continued)

C)
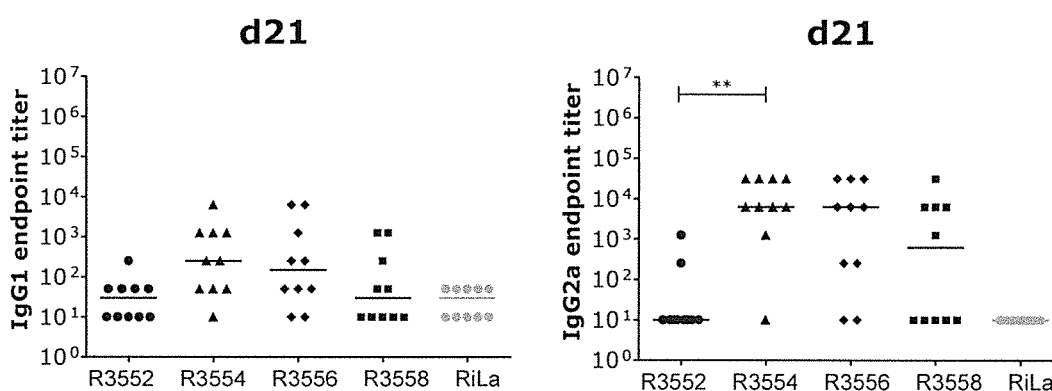
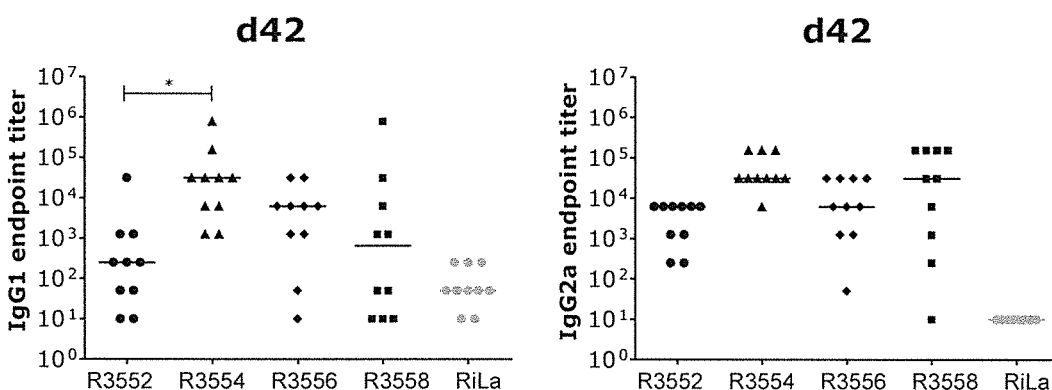
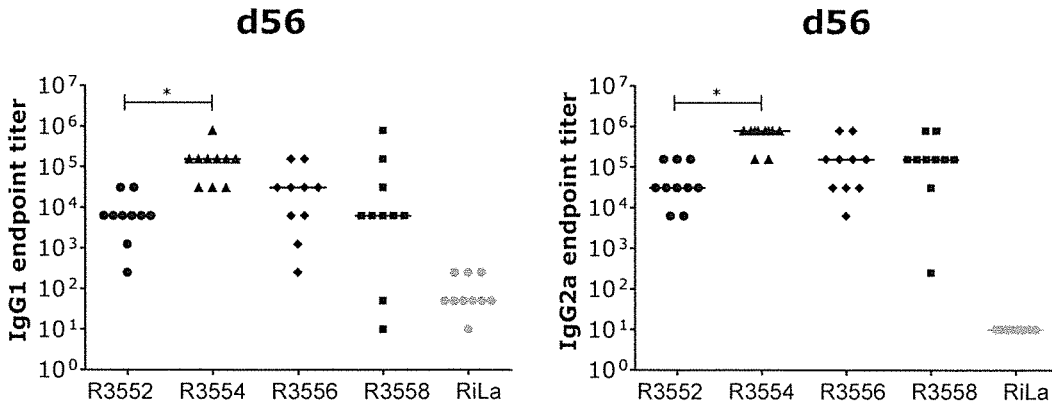
Fig. 15 (continued)

D)

A)
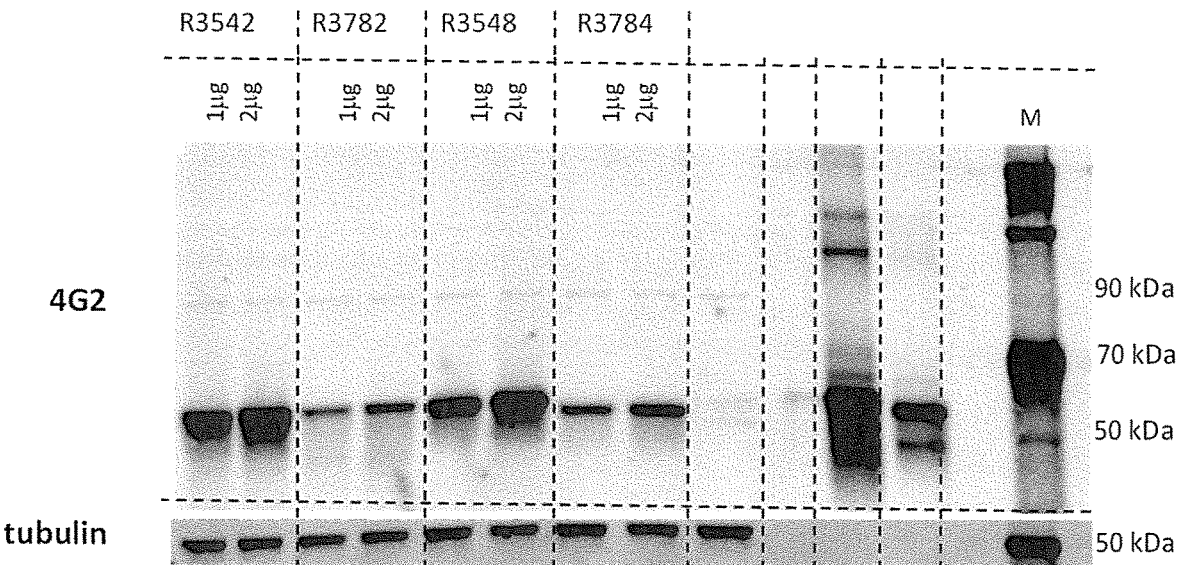
B)
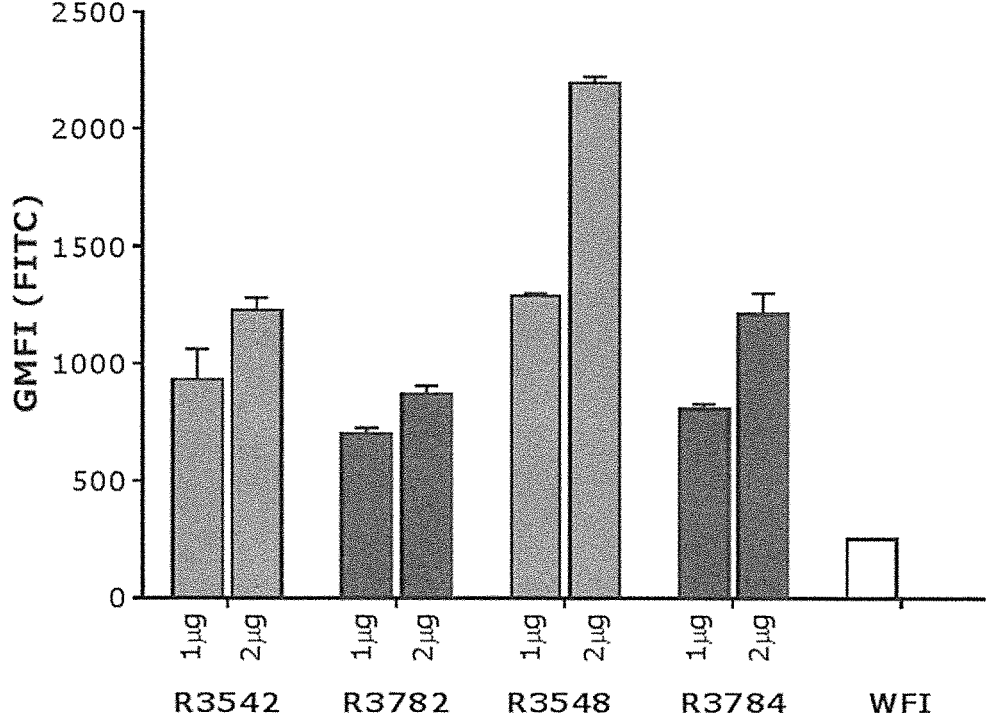
Fig. 16

cell lysates

4G2 Ab

α-αβ tubulin supernatants

4G2 Ab

α-αβ tubulin

Fig. 18

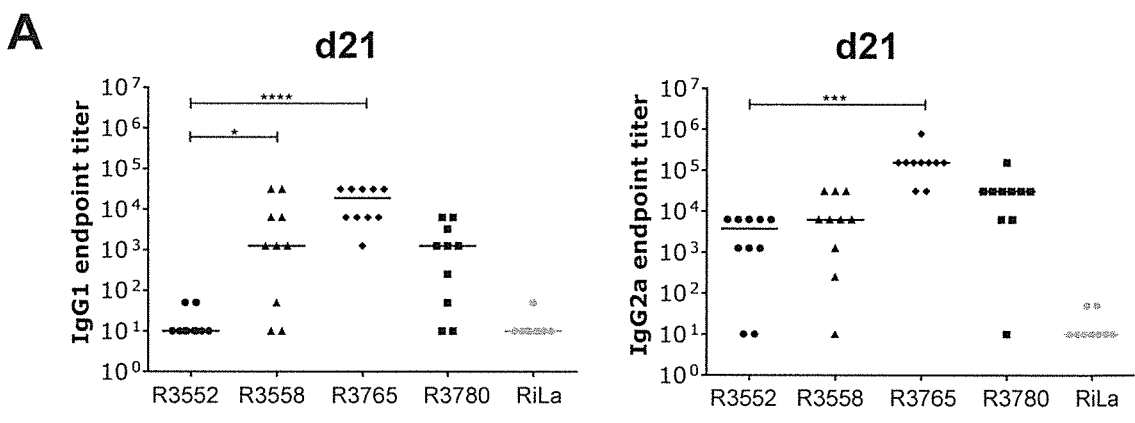
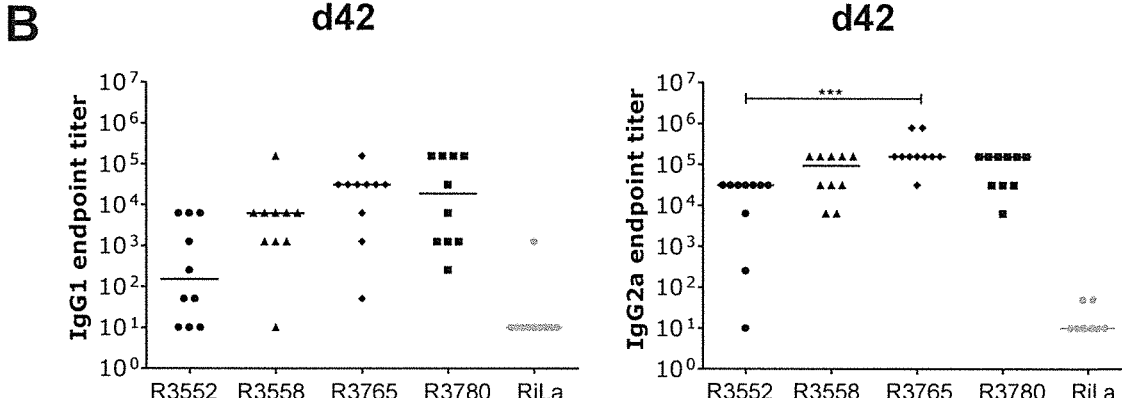
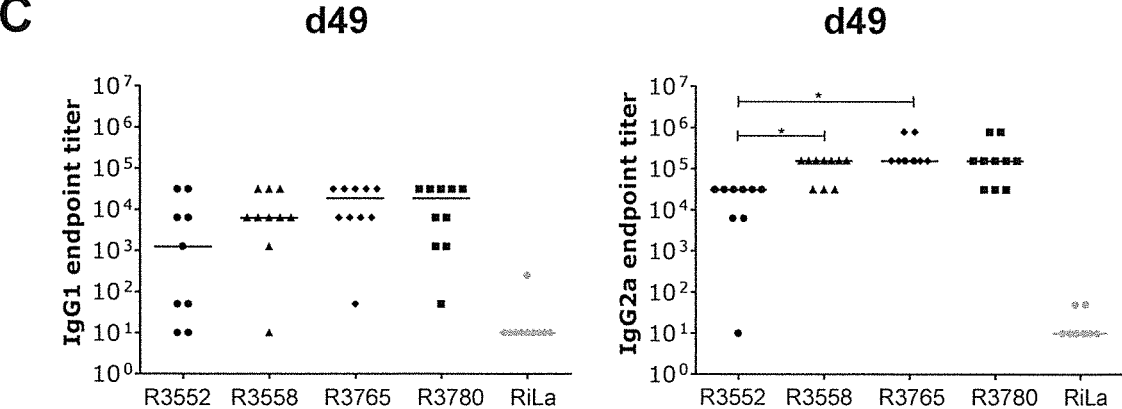
Fig. 19

A
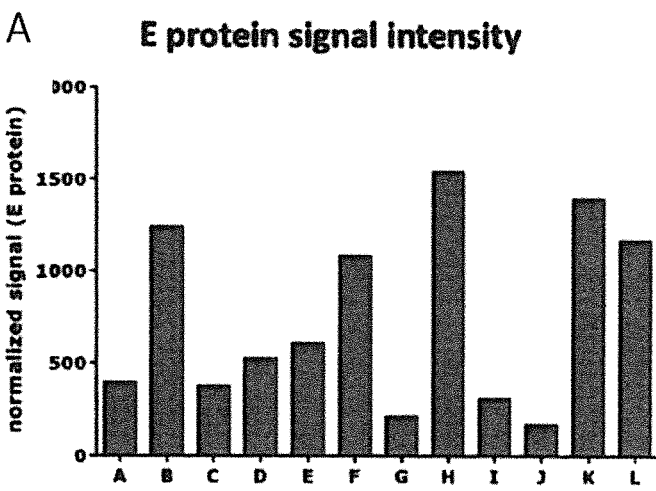
B
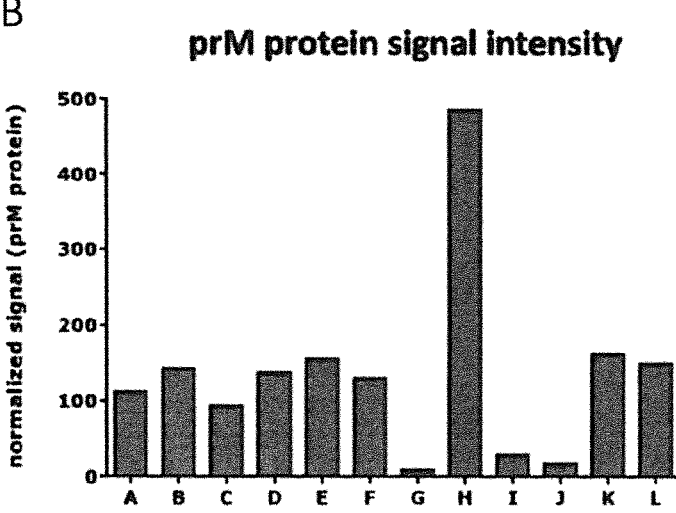
C
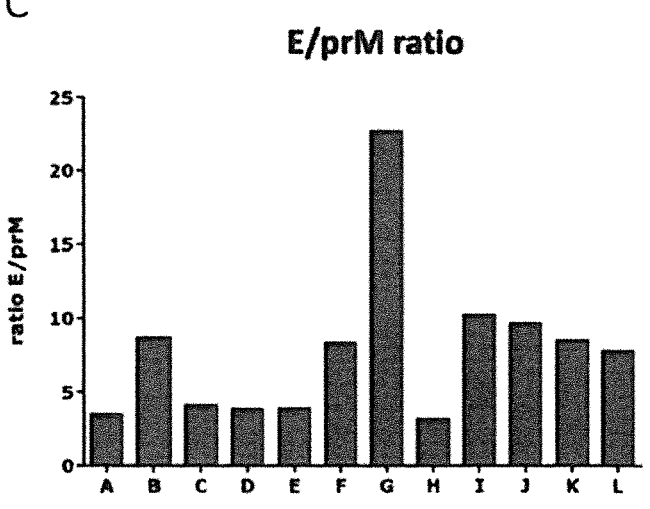
Fig. 22 cell lysates
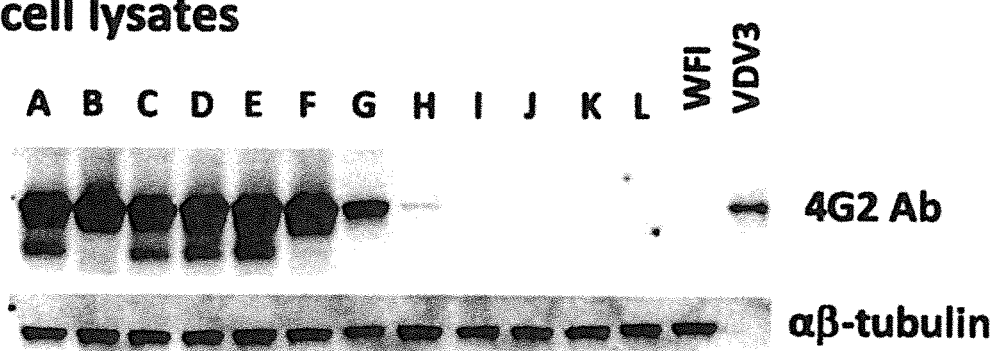
supernatants          VLP
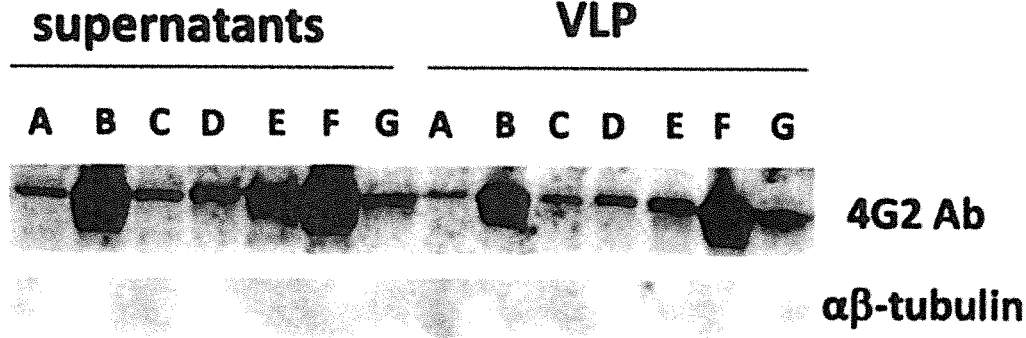
Fig. 23

4G2 Ab

5C12 Ab

4G2 Ab
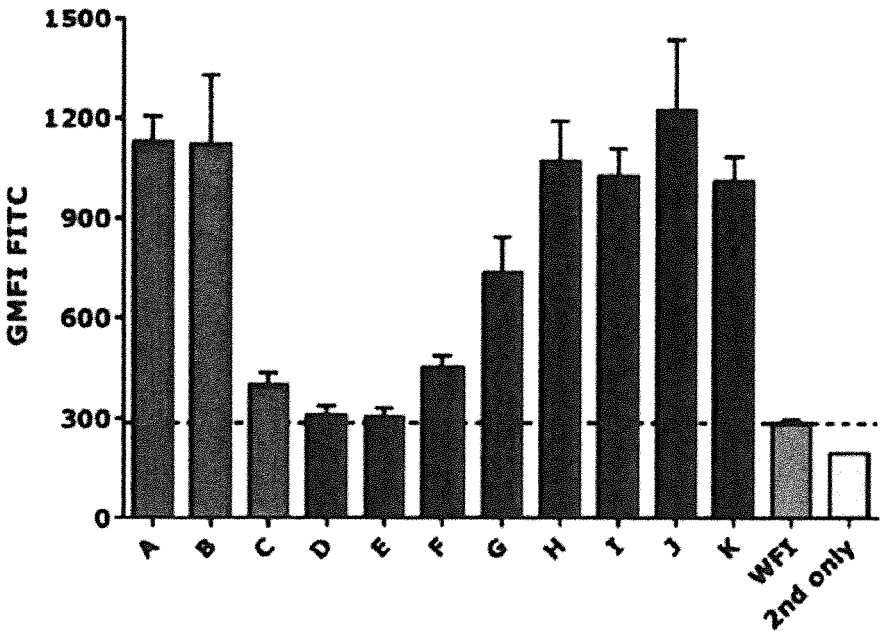
5C12 Ab
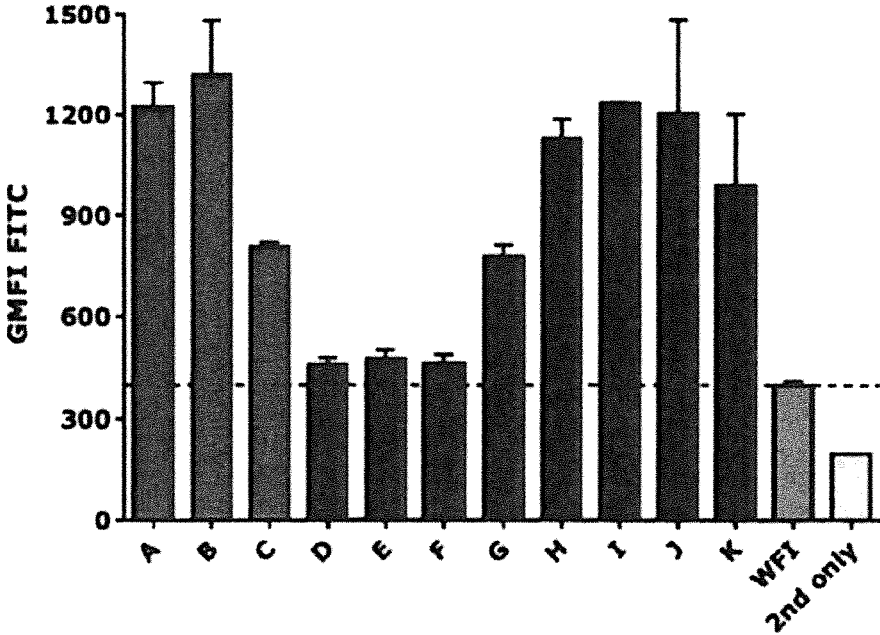
Fig. 30

4G2 Ab
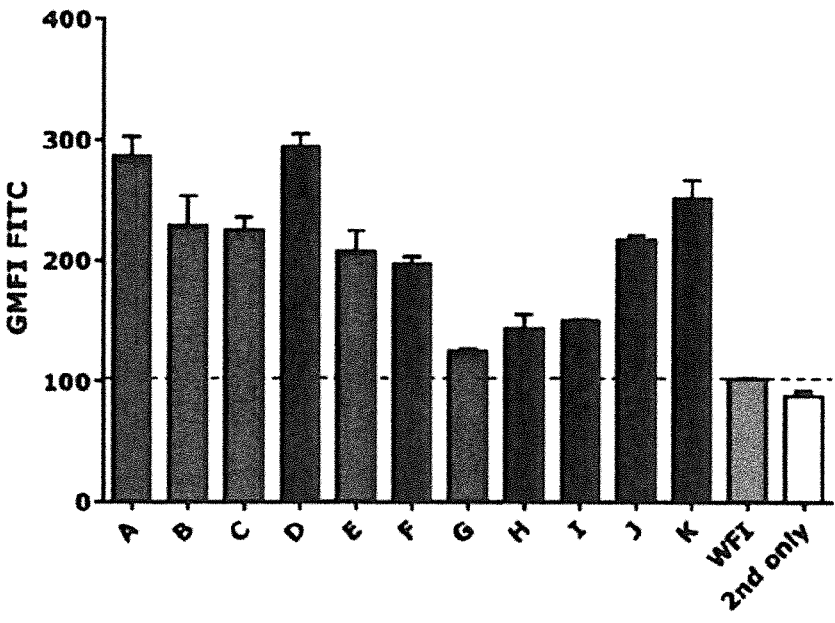
5C12 Ab
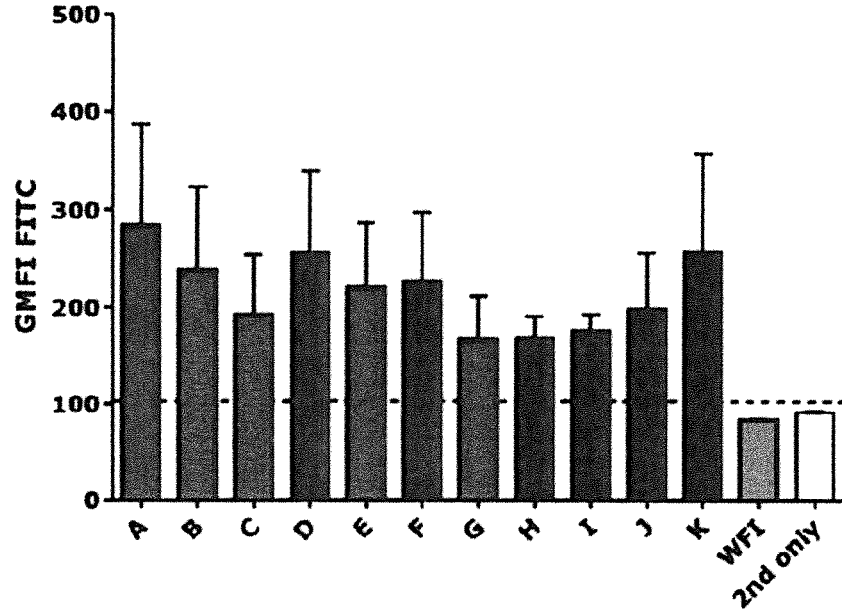
Fig. 33

A
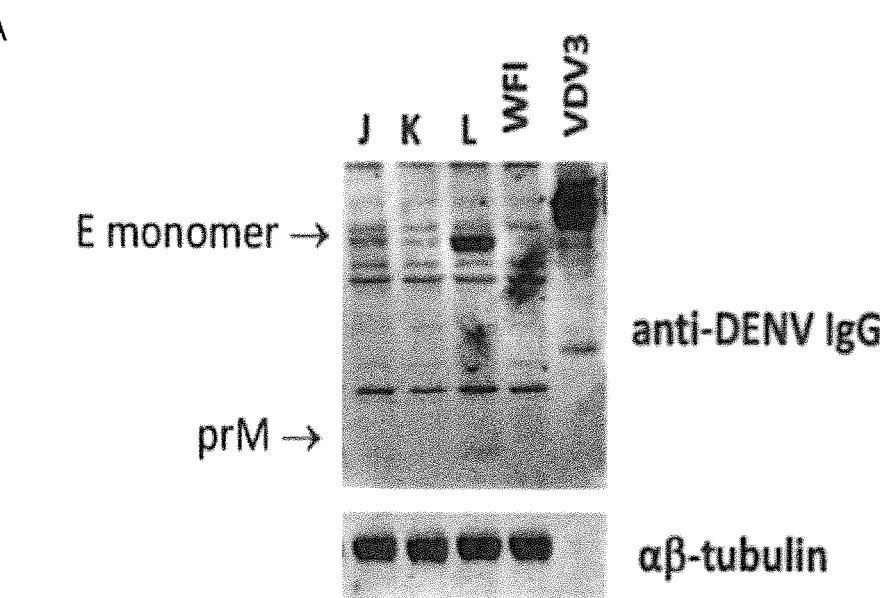
B
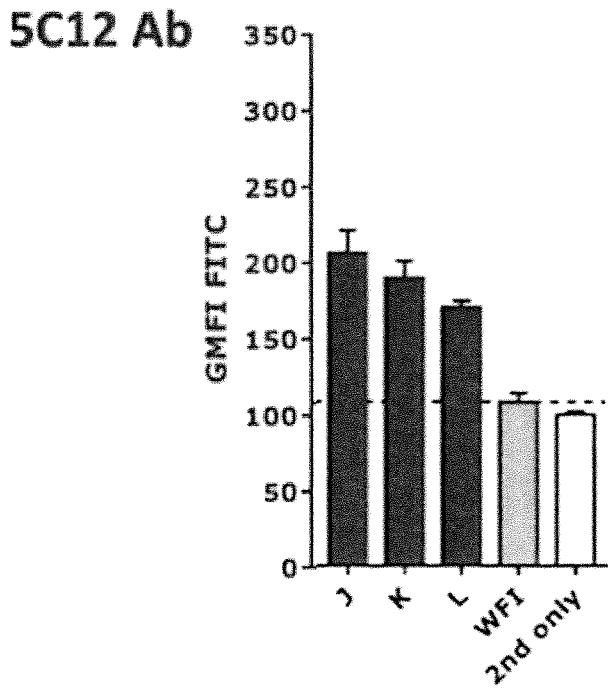
Fig. 34

R3912 i.d. Tropis, 80μg (d0, 28, 56)
R3912 i.d. Tropis, 80μg (d0, 28)
blocking buffer

- R3912 i.d. Tropis, 80μg (d0, 28, 56)
- R3912 i.d. Tropis, 80μg (d0, 28)
- blocking buffer

Fig. 43

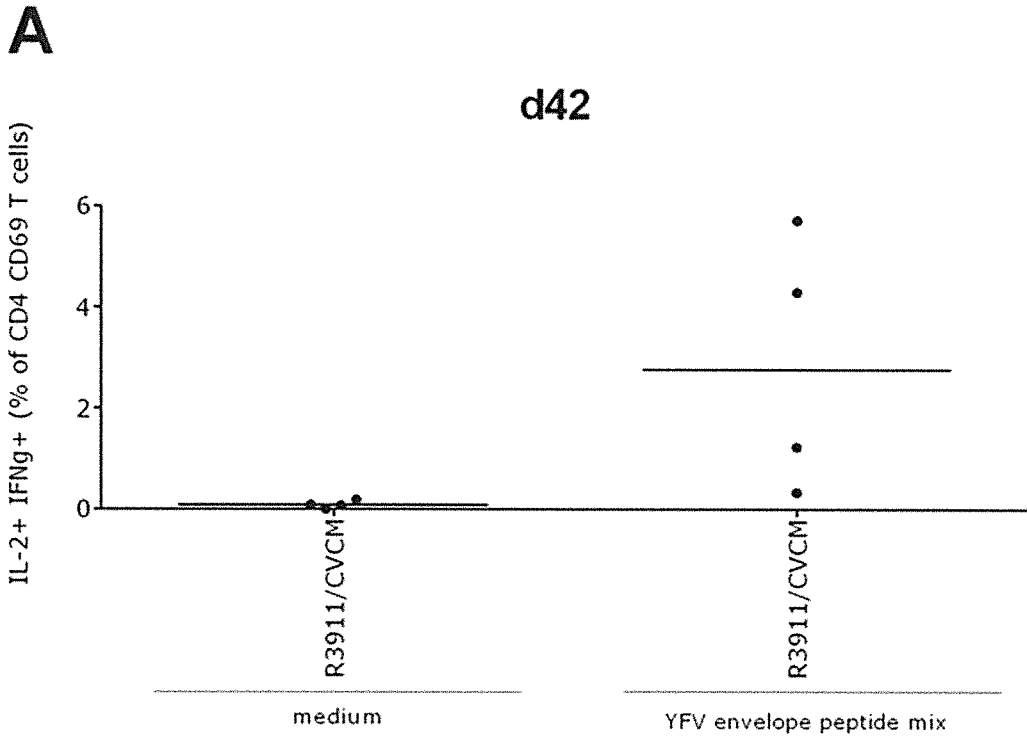
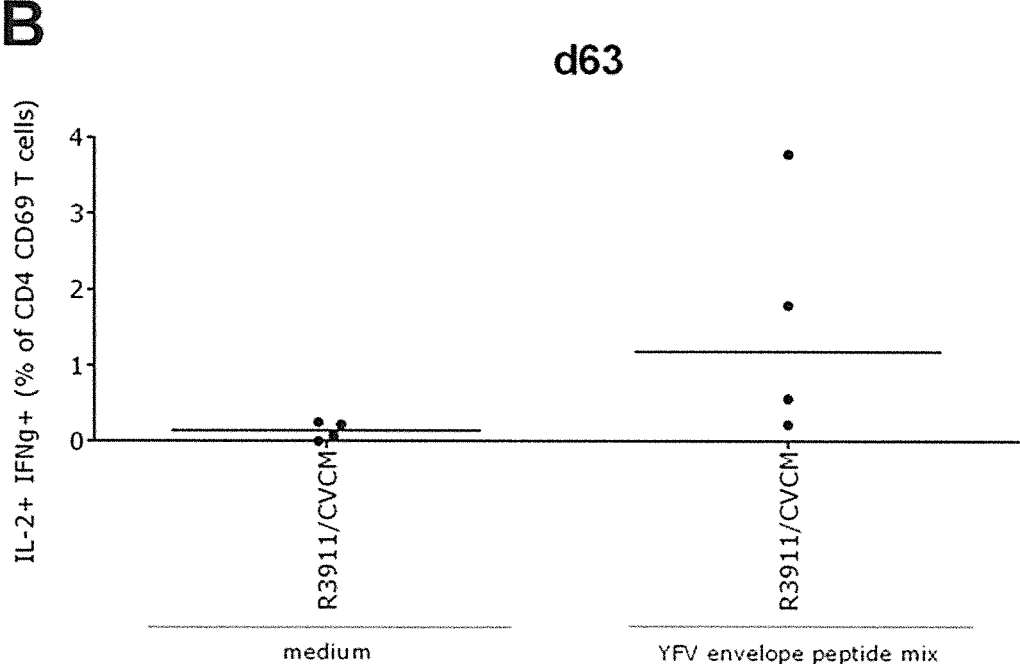
Fig. 46

→ R3911/CVCM, i.m. needle, 200μg (d0, 28)
→ blocking buffer

FLAVIVIRUS VACCINE

This application is a divisional of U.S. application Ser. No. 16/772,131, filed Jun. 11, 2020, which is a national phase application under 35 U.S.C. § 371 of International Application No. PCT/EP2018/084607, filed Dec. 12, 2018, the entire contents of each of which are hereby incorporated by reference. International Application No. PCT/EP2018/084607 claims benefit of European Application No. 17207141.7, filed Dec. 13, 2017.

This application contains a Sequence Listing XML, which has been submitted currently herewith on optical disc by Priority Express Mail and is hereby incorporated by reference in its entirety. Said Sequence Listing XML, created on Dec. 27, 2023, is named CRVCP0198USD1.xml and is 255,653,259 bytes in size.

This invention was made with the Government support under Agreement No. HR0011-11-3-0001 awarded by DARPA. The Government has certain rights in the invention.

INTRODUCTION

The present invention is directed to an artificial nucleic acid and to a polypeptide suitable for use in the treatment or prophylaxis of an infection with a flavivirus, in particular an infection with yellow fever virus or with dengue virus, or of a disorder related to such an infection. The present invention is also directed to a composition, preferably an immunogenic composition, comprising the artificial nucleic acid or the inventive polypeptide. In particular, the present invention concerns an immunogenic composition against a flavivirus, such as yellow fever virus or dengue virus. Further, the invention concerns a kit, particularly a kit of parts, comprising the artificial nucleic acid, polypeptide or (immunogenic) composition. The invention is further directed to a method of treating or preventing a disorder or a disease, first and second medical uses of the artificial nucleic acid, polypeptide, composition, in particular the first and second medical uses of the immunogenic composition according to the invention.

Flaviviruses are a group of enveloped positive-stranded RNA arboviruses. Among the group of flaviviruses there are more than 40 human pathogens, responsible for considerable morbidity and mortality throughout the world causing symptoms ranging from rather unspecific pseudo-flu-like syndromes, to severe encephalitic or hemorrhagic disease. Taxonomically they form a genus of more than 70 different viruses in the family Flaviviridae and comprise the mosquito-borne yellow fever virus (YFV) and dengue virus (DENV), both having a significant impact on public health in their respective endemic and/or epidemic regions.

DENV and YFV virus particles are 40-50 nm in diameter with a positive-sense, non-segmented, single-stranded RNA of approximately 11 kb. The genome encodes a single polyprotein that is processed by host specific or viral proteases into ten functionally distinct proteins including three structural proteins (capsid (C), premembrane (prM) and envelope (E)) which are incorporated into the viral particle, and seven non-structural proteins (NS1, NS2A, NS2B, NS3, NS4A, NS4B, NS5). The E protein interacts with cellular receptors and viral uptake occurs via receptor-mediated endocytosis followed by fusion of viral and endosomal membrane and release of the nucleocapsid into the cytoplasm. Translation and replication of the viral genome occurs in the cytoplasm in association with intracellular membranes. Particle assembly takes place in the endoplasmic reticulum and first leads to the formation of immature viruses with a rough surface formed by spikes of 60 trimers of prME heterodimers. In the acidic environment of the trans-Golgi network the trimeric spikes undergo a conformational change into 90 dimers and expose the prM protein cleavage site. The peptide pr is cleaved from prM by the cellular protease furin to form a smooth, mature virus particle with a herringbone-like arrangement of 90 E homodimers with T=3 pseudo-icosahedral symmetry. The prM cleavage allows E to adopt the conformational state required for its entry functions, i.e. receptor-binding and acidic-pH-induced membrane fusion after uptake by receptor-mediated endocytosis.

YFV is endemic in tropical and subtropical regions in Africa and South-America and causes epidemics of hemorrhagic fever with high fatality rates from 20-50% resulting in an estimated number of 200,000 cases with 30,000 deaths annually.

DENV is the most prevalent arthropod-borne viral infection in the world. Dengue is endemically transmitted in all tropical and subtropical regions of the world. The endemic regions of DENV overlap with those of YFV in Africa and South-America. However, DENV extends also to large parts of South-East Asia, where YFV is (currently) not found. Roughly 3.6 billion people live in dengue-endemic areas and the virus causes approximately 400 million infections and 100 million symptomatic cases annually. Dengue disease is caused by four antigenically distinct, but closely related DENV serotypes, DENV 1-4 which possess approximately 60-80% amino acid sequence homology. Infection with one dengue serotype provides long-lasting homologous immunity. However, heterologous immunity is only partial and temporary (Sabin, 1952, Am. J. Trop. Med. Hyg., 1:30-50). Infections with dengue can be asymptomatic or cause a spectrum of clinical disease ranging from mild fever (dengue fever, DF) to the more life-threatening dengue hemorrhagic fever (DHF) and dengue shock syndrome (DSS) which is frequently fatal. In Asia, DHF and DSS are observed primarily in children, with approximately 90% of those with DHF being less than 15 years of age (Malavige et al., 2004, Postgrad Med. 1, 80:588-601; Meulen et al., 2000, Trop. Med. Int. Health, 5:325-9). In contrast, outbreaks in the Caribbean and Central America have predominantly affected adults (Malavige et al., 2004, Postgrad Med. J., 80:588-601). The pathogenesis of DHF is not clearly understood. One favored hypothesis that may explain the virulence triggered by a second infection with another serotype is called antibody-dependent enhancement (ADE). Immune responses to the primary dengue infection include the induction of serotype-specific and cross-reactive B and T cells. B cells produce serotype-specific neutralizing antibodies as well as antibodies which show moderate to none cross-reactive neutralizing activity. Following a heterotypical secondary infection, these moderately- and non-neutralizing antibodies promote the binding and uptake of infectious dengue particles by Fc-receptor-expressing monocytes and macrophages.

In the 1930s, a live attenuated YF vaccine virus (17D) was developed which confers long-term immunity upon a single injection. However, in some cases vaccination with the 17D YF vaccine may elicit severe side effects such as anaphylactic reactions and yellow-fever-vaccine-associated neurologic disease (YEL-AND). Anaphylaxis is most likely caused by allergic reactions to proteins from eggs or gelatine used in vaccine production. The fatality associated with YEL-AND appears to be relatively low in general, but higher among recipients 60 years of age or older and is presumably attributed to the injection of a live attenuated virus into recipients who fail to adequately control the replication of virus (Hayes 2010. Vaccine 28(51):8073-6). Other risks associated with the use of the live attenuated YF vaccine are transmission of the 17D virus through transfusion of blood products from recently vaccinated donors and vertical mother-to-child transmission.

Therefore, a safe and effective, non-infectious vaccine would be desirable in order to avoid vaccine-associated adverse events and to allow vaccination of young infants and immunocompromised recipients, for whom the live 17D vaccine is contraindicated, as well as pregnant and nursing women and elderly people.

Dengue vaccine development is challenging due to the existence of four serotypes of the virus, which a vaccine must protect against. Therefore it would be desirable to have a dengue vaccine eliciting a durable neutralizing antibody response against all four DENV virus serotypes. Numerous vaccine candidates including live attenuated, inactivated, recombinant subunit, DNA and viral vectored vaccines are in various stages of clinical development.

Recently, different mRNA-based flavivirus vaccines were described (WO2015/164674, WO2017/070624, WO2017/015463, Sci Rep. 2017 Mar. 21; 7(1):252. doi: 10.1038/s41598-017-00193-w., Nature. 2017 Mar. 9; 543(7644):248-251. doi: 10.1038/nature21428. Epub 2017 Feb. 2.).

Summarizing the above, there remains an unmet medical need to provide safe and effective DENV and YFV vaccines, which are preferably suitable for pre-exposure prophylaxis or post-exposure prophylaxis. Moreover, there is a need for the development of a safe and effective DENV and YFV vaccine that is affordable, that can be manufactured rapidly, and which preferably has superior characteristics in terms of stability (e.g. heat stability).

Therefore, it is the object of the underlying invention to provide safe and effective immunogenic compositions against flaviviruses, such as YFV or DENV, which are preferably suitable for pre-exposure prophylaxis or for post-exposure prophylaxis. Furthermore, it is the object of the present invention to provide an effective immunogenic composition directed against YFV or DENV, which can be stored without cold chain. It is another object of the present invention to provide such immunogenic compositions, which allow for rapid and scalable production.

Additionally, it is one further object to avoid antibody-dependent enhancement by applying a flavivirus vaccine.

This object is solved by the claimed subject matter.

DESCRIPTION OF THE INVENTION

The present application is filed together with a sequence listing in electronic format, which is part of the description of the present application. The information contained in the electronic format of the sequence listing filed together with this application is incorporated herein by reference in its entirety. Where reference is made herein to a "SEQ ID NO:" the corresponding nucleic acid sequence or amino acid (aa) sequence in the sequence listing having the respective identifier is referred to. For many sequences, the sequence listing also provides detailed information, e.g. regarding certain structural features, sequence optimizations, Gen-Bank identifiers, or regarding its coding capacity. In particular, such information may be provided under the identifier <223> in the sequence listing. Accordingly, information provided under identifier <223> is explicitly included herein in its entirety and has to be understood as part of the description of the invention.

For the sake of clarity and readability the following definitions are provided. Any technical feature mentioned for these definitions may be read on each and every embodiment of the invention. Additional definitions and explanations may be specifically provided in the context of these embodiments.

Definitions

Adaptive immune response: The term "adaptive immune response" as used herein will be recognized and understood by the person of ordinary skill in the art, and is for example intended to refer to an antigen-specific response of the immune system. Antigen specificity allows for the generation of responses that are tailored to specific pathogens or pathogen-infected cells. The ability to mount these tailored responses is usually maintained in the body by "memory cells" (B-cells). In the context of the invention, the antigen (e.g. DENV or YFV peptide, protein, polyprotein) is preferably provided by the artificial nucleic acid coding sequence encoding at least one antigenic peptide, protein or polyprotein of the invention.

Adaptive immune system: The "adaptive immune system" is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hyper mutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Adjuvant, adjuvant component: An "adjuvant" or an "adjuvant component" in the broadest sense is typically a pharmacological and/or immunological agent that may modify, e.g. enhance, the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antigen: In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the sense of the present invention an antigen may be the product of translation of a provided nucleic acid, preferably an mRNA as defined herein. In this context, also fragments, variants and derivatives of peptides and proteins comprising at least one epitope are understood as antigens.

Artificial nucleic acid: An "artificial nucleic" acid may typically be understood to be a nucleic acid, e.g. a DNA or an RNA that does not occur naturally. In other words, an artificial nucleic acid may be understood as a non-natural nucleic acid. Such nucleic acid may be non-natural due to its individual sequence (which does not occur naturally) and/or due to other modifications, e.g. structural modifications of nucleotides which do not occur naturally or other elements that do not occur naturally (e.g. heterologous UTR elements etc.). An artificial nucleic acid may be a DNA molecule, an RNA molecule or a hybrid-molecule comprising DNA and RNA portions. Typically, artificial nucleic acids may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid" is not restricted to mean "one single molecule" but is, typically, understood to comprise an ensemble of identical molecules. Accordingly, it may relate to a plurality of identical molecules contained in an aliquot.

Bicistronic RNA, multicistronic RNA: A bicistronic or multicistronic RNA is typically an mRNA, that may have two (bicistronic) or more (multicistronic) coding regions. A coding region in this context is a sequence of codons that is translatable into a peptide or protein.

Carrier/polymeric carrier: A "carrier" in the context of the invention may typically be a compound that facilitates transport and/or complexation of another compound (cargo). A "polymeric carrier" is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component or a cationic or polycationic compound.

Cationic component, cationic or polycationic compounds: The terms "cationic component" or "cationic or polycationic compounds" typically refers to charged molecules, which are positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic lipid or a cationic peptide or protein, which is positively charged under physiological conditions, particularly under physiological conditions in vivo. A "cationic lipid" is preferably a cationic lipid as described herein, more preferably a cationic lipid suitable for forming a lipid nanoparticle. A "cationic peptide or protein" may contain at least one positively charged amino acid (aa), or more than one positively charged aa, e.g. selected from Arg, His, Lys or Orn. Accordingly, "polycationic" components are also within the scope exhibiting more than one positive charge under the conditions given. 5'-cap: A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. A 5'-cap structure may be introduced into an artificial nucleic acid of the invention, for example, by providing the respective nucleotides (cap analogs) during transcription ("co-translational capping") or by enzymatically capping a nucleic acid, such as an RNA.

Cellular immunity/cellular immune response: The term "cellular immunity" relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. Such cells may be virus-infected or infected with intracellular bacteria, or cancer cells displaying tumor antigens. Further characteristics may be activation of macrophages and natural killer cells, enabling them to destroy pathogens and stimulation of cells to secrete a variety of cytokines that influence the function of other cells involved in adaptive immune responses and innate immune responses.

Coding region, coding sequence: A "coding region" or "coding sequence" (cds) in the context of the invention is typically a sequence/region on a nucleic acid of several nucleotide triplets, which may be translated into a peptide or protein. A coding region preferably contains a start codon, i.e. a combination of three subsequent nucleotides coding usually for the aa methionine (ATG), at its 5'-end and a subsequent region which usually exhibits a length which is a multiple of 3 nucleotides. A coding region is preferably terminated by a stop-codon (e.g., TAA, TAG, TGA). Typically, this is the only stop-codon of the coding region. Thus, a coding region in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The coding region may be isolated or it may be incorporated in a longer nucleic acid sequence, for example in a vector or an mRNA. In the context of the present invention, a coding region may also be termed "protein coding region".

Epitope (also called "antigen determinant"): Epitopes can typically be distinguished in T cell epitopes and B cell epitopes. T cell epitopes or parts of the proteins in the context of the present invention may comprise fragments preferably having a length of about 6 to about 20 or even more amino acids (aa), e.g. fragments as processed and presented by MHC class I molecules, preferably having a length of about 8 to about 10 aa, e.g. 8, 9, or 10, (or even 11, or 12 aa), or fragments as processed and presented by MHC class II molecules, preferably having a length of about 13 or more aa, e.g. 13, 14, 15, 16, 17, 18, 19, 20 or even more aa, wherein these fragments may be selected from any part of the aa sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens (in particular a YFV protein or a DENV protein, fragment or variant thereof) as defined herein, preferably having 5 to 15 aa, more preferably having 5 to 12 aa, even more preferably having 6 to 9 aa, which may be recognized by antibodies, i.e. in their native form. Such epitopes of proteins or peptides may furthermore be selected from any of the herein mentioned variants of such proteins or peptides. In this context antigenic determinants can be conformational or discontinuous epitopes, which are composed of segments of the proteins or peptides as defined herein that are discontinuous in the aa sequence of the proteins or peptides as defined herein but are brought together in the three-dimensional structure or continuous or linear epitopes which are composed of a single polypeptide chain.

G/C modified: A G/C-modified nucleic acid may typically be a nucleic acid, preferably an artificial nucleic acid molecule as defined herein, based on a modified wild type sequence comprising a preferably increased number of guanosine and/or cytosine nucleotides as compared to the wild type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule.

Heterologous sequence: Two sequences are typically understood to be "heterologous" if they are not derivable from the same gene or in the same allele. I.e., although heterologous sequences may be derivable from the same organism, they naturally (in nature) do not occur in the same nucleic acid, such as in the same mRNA. In the context of the present invention, the expression "heterologous sequence" may refer, in particular, to a nucleic acid sequence or aa sequence that is not derived from the same gene, which encodes the at least one flavivirus protein, or a fragment or variant thereof, comprised in the at least one encoded polypeptide. A "heterologous sequence" may thus be, for example, a sequence derived from another flavivirus protein with respect to the at least one flavivirus protein, or the fragment or variant thereof, comprised in the encoded polypeptide or a sequence derived from another organism or from another viral genome.

Homolog (of a nucleic acid sequence/amino acid (aa) sequence): The term "homolog" typically refers to a sequence of the same or of another species that is related, but preferably not identical, to a reference sequence. The term "homolog" encompasses orthologs as well as paralogs. In the context of the present invention, a homolog of a nucleic acid sequence or of an aa sequence is preferably at least 5%, 10%, 20%, 30%, 40%, 50%, 60%, more preferably at least 70%, even more preferably at least 80%, even more preferably at least 90%, even more preferably at least 95%, most preferably at least 99%, identical to a reference sequence. It is further preferred that a "homolog" as used herein consists of a continuous stretch of entities, such as nucleotides or aa residues, corresponding to a continuous stretch of entities in the reference molecule, which represents at least 5%, 10%, 20%, preferably at least 30%, more preferably at least 40%, more preferably at least 50%, even more preferably at least 60%, even more preferably at least 70%, and most preferably at least 80% of the total (i.e. full-length) reference molecule.

Humoral immunity/humoral immune response: Humoral immunity refers typically to antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Immunogen: In the context of the present invention an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid, preferably an artificial nucleic acid as defined herein. Typically, an immunogen elicits at least an adaptive immune response.

Immunogenic composition: An immunogenic composition in the context of the invention may be typically understood to be a (pharmaceutical) composition containing at least one component, which is able to induce an immune response or from which a component which is able to induce an immune response is derivable. Such immune response is preferably an adaptive immune response, more preferably an adaptive immune response directed against YFV protein or DENV protein, or a fragment or variant thereof as defined herein. Therefore an immunogenic composition preferably comprises at least one antigen or a nucleic acid, preferably an mRNA, encoding at least one antigen or a fragment thereof, preferably as described herein.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. The (immunogenic) composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Nucleic acid: A "nucleic acid" is a molecule comprising, preferably consisting of nucleic acid components. The term nucleic acid preferably refers to DNA or RNA molecules. It is preferably used synonymous with the term "polynucleotide". Preferably, a nucleic acid is a polymer comprising or consisting of nucleotide monomers, which are covalently linked to each other by phosphodiester-bonds of a sugar/phosphate-backbone. The term "nucleic acid" also encompasses modified nucleic acids, such as base-modified, sugar-modified or backbone-modified etc. DNA or RNA molecules.

Nucleic acid sequence/amino acid (aa) sequence: The sequence of a nucleic acid is typically understood to be the particular and individual order, i.e. the succession of its nucleotides. The sequence of a protein or peptide is typically understood to be the order, i.e. the succession of its aa residues.

Peptide: A peptide or polypeptide is typically a polymer of aa monomers, linked by peptide bonds. A peptide typically contains less than 50 monomer units. Nevertheless, the term peptide is not a disclaimer for molecules having more than 50 monomer units. Long peptides are also called polypeptides, typically having between 50 and 600 monomeric units. The term "polypeptide" as used herein, however, is typically not limited by the length of the molecule it refers to. In the context of the present invention, the term "polypeptide" may also be used with respect to peptides comprising less than 50 (e.g. 10) aa or peptides comprising even more than 600 aa.

Pharmaceutically effective amount, effective amount: A (pharmaceutically) "effective amount" in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein: A protein typically comprises one or more peptides or polypeptides. A protein is typically folded into 3-dimensional form, which may be required for the protein to exert its biological function.

Poly(A) sequence: A poly(A) sequence, also called poly (A) tail or 3'-poly(A) tail, is typically understood to be a sequence of adenosine nucleotides, e.g., of up to about 400 adenosine nucleotides, e.g. from about 20 to about 400, preferably from about 50 to about 400, more preferably from about 50 to about 300, even more preferably from about 50 to about 250, most preferably from about 60 to about 250 adenosine nucleotides. A poly(A) sequence is typically located at the 3'-end of an mRNA. In the context of the present invention, a poly(A) sequence may be located within an mRNA or any other nucleic acid, such as, e.g., in a vector, for example, in a vector serving as template for the generation of an RNA, preferably an mRNA, e.g., by transcription of the vector.

Polyadenylation: Polyadenylation is typically understood to be the addition of a poly(A) sequence to a nucleic acid, such as an RNA molecule, e.g. to a premature mRNA. Polyadenylation may be induced by a so called polyadenylation signal. This signal is preferably located within a stretch of nucleotides at the 3'-end of a nucleic acid, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called pre-mature-mRNA). Typically, RNA maturation (from pre-mRNA to mature mRNA) comprises the step of polyadenylation.

RNA, mRNA: RNA is the usual abbreviation for ribonucleic acid. It is a nucleic acid, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. Typically, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, a coding region, a 3'-UTR and a poly(A) sequence. Aside from messenger RNA, several non-coding types of RNA exist which may be involved in regulation of transcription and/or translation.

RNA in vitro transcription: The terms "RNA in vitro transcription" or "in vitro transcription" relate to a process wherein RNA is synthesized in a cell-free system (in vitro). DNA, particularly plasmid DNA, is used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase.

Particular examples of DNA-dependent RNA polymerases are the T7, T3, and SP6 RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, for example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Methods for in vitro transcription are known in the art (see, e.g., Geall et al. (2013) Semin. Immunol. 25(2): 152-159; Brunelle et al. (2013) Methods Enzymol. 530:101-14). Reagents used in said method typically include:

1) a linearized DNA template with a promoter sequence that has a high binding affinity for its respective RNA polymerase such as bacteriophage-encoded RNA polymerases;

2) ribonucleoside triphosphates (NTPs) for the four bases (adenine, cytosine, guanine and uracil);

3) optionally, a cap analogue as defined above (e.g. m7G(5')ppp(5')G (m7G));

4) a DNA-dependent RNA polymerase capable of binding to the promoter sequence within the linearized DNA template (e.g. T7, T3 or SP6 RNA polymerase);

5) optionally, a ribonuclease (RNase) inhibitor to inactivate any contaminating RNase;

6) optionally, a pyrophosphatase to degrade pyrophosphate, which may inhibit transcription;

7) $MgCl_2$, which supplies $Mg^{2+}$ ions as a co-factor for the polymerase;

8) a buffer to maintain a suitable pH value, which can also contain antioxidants (e.g. DTT), and/or polyamines such as spermidine at optimal concentrations.

Sequence identity: Two or more sequences are identical if they exhibit the same length and order of nucleotides or amino acids. The percentage of identity typically describes the extent, to which two sequences are identical, i.e. it typically describes the percentage of nucleotides that correspond in their sequence position with identical nucleotides of a reference sequence. In order to determine the degree of identity, the sequences to be compared are considered to exhibit the same length, i.e. the length of the longest sequence of the sequences to be compared.

This means that a first sequence consisting of 8 nucleotides is 80% identical to a second sequence consisting of 10 nucleotides comprising the first sequence. Hence, in the context of the present invention, identity of sequences preferably relates to the percentage of nucleotides of a sequence which have the same position in two or more sequences having the same length. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1993), PNAS USA, 90:5873-5877 or Altschul et al. (1997), Nucleic Acids Res., 25:3389-3402. Such an algorithm is integrated in the BLAST program. Sequences which are identical to the sequences of the present invention to a certain extent can be identified by this program.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acids, such as DNA or RNA (e.g. mRNA) molecules, into cells, preferably into eukaryotic cells. In the context of the present invention, the term "transfection" encompasses any method known to the skilled person for introducing nucleic acids into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vector: The term "vector" refers to a nucleic acid, preferably to an artificial nucleic acid. A vector in the context of the present invention is suitable for incorporating or harboring a desired nucleic acid sequence, such as a nucleic acid sequence comprising a coding region. Such vectors may be storage vectors, expression vectors, cloning vectors, transfer vectors etc. A storage vector is a vector which allows the convenient storage of a nucleic acid, for example, of an mRNA molecule. Thus, the vector may comprise a sequence corresponding, e.g., to a desired mRNA sequence or a part thereof, such as a sequence corresponding to the coding region and the 3'-UTR and/or the 5'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector which is suitable for transferring nucleic acids into cells or organisms, for example, viral vectors. A vector in the context of the present invention may be, e.g., an RNA vector or a DNA vector.

Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid which is suitable for storing, transporting, and/or administering a pharmaceutically active compound. 3'-untranslated region (3'-UTR): Generally, the term "3'-UTR" refers to a part of the artificial nucleic acid, which is located 3' (i.e. "downstream") of a coding region and which is not translated into protein. Typically, a 3'-UTR is the part of an mRNA which is located between the protein coding region (coding region or coding sequence (CDS)) and the poly(A) sequence of the mRNA. In the context of the invention, the term 3'-UTR may also comprise elements, which are not encoded in the template, from which an RNA is transcribed, but which are added after transcription during maturation, e.g. a poly(A) sequence. A 3'-UTR of the mRNA is not translated into an aa sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5' capping, splicing the pre-mature mRNA to excize optional introns and modifications of the 3'-end, such as polyadenylation of the 3'-end of the pre-mature mRNA and optional endo- or exonuclease cleavages etc. In the context of the present invention, a 3'-UTR corresponds to the sequence of a mature mRNA which is located between the stop codon of the protein coding region, preferably immediately 3' to the stop codon of the protein coding region, and the poly(A) sequence of the mRNA. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", is the sequence which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR. Preferably, the 3'UTRs have a length of more than 20, 30, 40 or 50 nucleotides.

5'-untranslated region (5'-UTR): Generally, the term "5'-UTR" refers to a part of the artificial nucleic acid, which is located 5' (i.e. "upstream") of a coding region and which is not translated into protein. A 5'-UTR is typically understood to be a particular section of messenger RNA (mRNA), which is located 5' of the coding region of the mRNA. Typically, the 5'-UTR starts with the transcriptional start site and ends one nucleotide before the start codon of the coding region. Preferably, the 5'-UTRs have a length of more than 20, 30, 40 or 50 nucleotides. The 5'-UTR may comprise elements for controlling gene expression, also called regulatory elements. Such regulatory elements may be, for example, ribosomal binding sites. The 5'-UTR may be post transcriptionally modified, for example by addition of a 5'-cap. A 5'-UTR of the mRNA is not translated into an aa sequence.

The 5'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5' capping, splicing the pre-mature mRNA to excize optional introns and modifications of the 3'-end, such as polyadenylation of the 3'-end of the pre-mature mRNA and optional endo-/or exonuclease cleavages etc. In the context of the present invention, a 5'-UTR corresponds to the sequence of a mature mRNA which is located between the start codon and, for example, the 5'-cap. Preferably, the 5'-UTR corresponds to the sequence which extends from a nucleotide located 3' to the 5'-cap, more preferably from the nucleotide located immediately 3' to the 5'-cap, to a nucleotide located 5' to the start codon of the protein coding region, preferably to the nucleotide located immediately 5' to the start codon of the protein coding region. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene" is the sequence which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence (both sense and antisense strand and both mature and immature) of the 5'-UTR.

5'-Terminal Oligopyrimidine Tract (TOP): The 5'-terminal oligopyrimidine tract (TOP) is typically a stretch of pyrimidine nucleotides located in the 5'-terminal region of a nucleic acid, such as the 5'-terminal region of certain mRNA molecules or the 5'-terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5'-terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'-end with a cytosine nucleotide. In TOP genes and TOP mRNAs, the TOP-motif preferably starts at its 5'-end with the transcriptional start site and ends one nucleotide 5' to the first purin residue in said gene or mRNA. A TOP motif in the sense of the present invention is preferably located at the 5'-end of a sequence which represents a 5'-UTR or at the 5'-end of a sequence which codes for a 5'-UTR. Thus, preferably, a stretch of 3 or more pyrimidine nucleotides is called "TOP motif" in the sense of the present invention if this stretch is located at the 5'-end of a respective sequence, such as the artificial nucleic acid, the 5'-UTR element of the artificial nucleic acid, or the nucleic acid sequence which is derived from the 5'-UTR of a TOP gene as described herein. In other words, a stretch of 3 or more pyrimidine nucleotides, which is not located at the 5'-end of a 5'-UTR or a 5'-UTR element but anywhere within a 5'-UTR or a 5'-UTR element, is preferably not referred to as "TOP motif".

TOP gene: TOP genes are typically characterized by the presence of a 5'-terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-cap to the nucleotide located 5' to the start codon. A 5'-UTR of a TOP gene typically does not comprise any start codons, preferably no upstream AUGs (uAUGs) or upstream coding regions (uORFs). Therein, upstream AUGs and upstream coding regions are typically understood to be AUGs and coding regions that occur 5' of the start codon (AUG) of the coding region that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g. the ATG) in the sequences according to SEQ ID NOs: 1-1363 of the patent application WO2013/143700, whose disclosure is incorporated herewith by reference. In this context a particularly preferred fragment of a 5'-UTR of a TOP gene is a 5'-UTR of a TOP gene lacking the 5' TOP motif. The terms "5'-UTR of a TOP gene" or "5'-TOP UTR" preferably refer to the 5'-UTR of a naturally occurring TOP gene.

DETAILED DESCRIPTION OF THE INVENTION

Artificial Nucleic Acid

According to a first aspect of the invention, an artificial nucleic acid is provided, which comprises at least one coding region encoding at least one polypeptide, wherein the at least one polypeptide comprises or consists of at least one flavivirus protein, or a fragment or variant of at least one flavivirus protein. Therein, the artificial nucleic acid is preferably characterized by any one of the features or by a plurality of features as described herein.

Without being limited to a specific flavivirus species, it is preferred that the flavivirus protein is derived from yellow fever virus or from dengue virus.

In particular, the present invention thus provides an artificial nucleic acid comprising
a) at least one coding region encoding at least one polypeptide comprising at least one flavivirus protein, wherein the flavivirus protein is selected from the group consisting of a capsid protein (C), a premembrane protein (prM), a membrane protein (M), an envelope protein (E) and a non-structural protein, or a fragment or variant of any one of these proteins, and
b) optionally an untranslated region (UTR) comprising at least one heterologous UTR element, wherein the flavivirus protein is preferably derived from yellow fever virus or from dengue virus.

The present invention is based on the surprising finding that the flavivirus protein comprised in the polypeptide encoded by the artificial nucleic acid, preferably a yellow fever virus (YFV) protein or a dengue virus (DENV) protein, can efficiently be expressed in a mammalian cell. It was further unexpectedly found that the artificial nucleic acid is suitable for eliciting an antigen-specific immune response against said flavivirus. The present invention thus provides a system that allows producing large quantities of a safe, effective and cost-efficient immunogenic composition directed against flavivirus, which does not require a cold chain.

As used herein, the term "flavivirus" typically comprises YFV, DENV, Japanese encephalitis virus, tick-borne encephalitis virus, West Nile virus and Zika virus. According to a preferred embodiment, the flavivirus protein, or the fragment or variant thereof, is derived from YFV or DENV. It is further preferred that the polypeptide encoded by the artificial nucleic acid does not comprise a Zika virus protein or a fragment or variant thereof. Preferably, the artificial nucleic acid does not comprise a nucleic acid sequence derived from a Zika virus.

In the context of the present invention, the terms "yellow fever virus" or the corresponding abbreviation "YFV" is not limited to a particular virus strain, variant or isolate, but comprises any yellow fever virus of any origin.

Likewise, the term "dengue virus" or the corresponding abbreviation "DENV" is not limited to a particular serotype, strain, variant or isolate, but comprises any dengue virus of any origin. In particular, the term "dengue virus" as used herein comprises any serotype of dengue virus, such as dengue virus serotype 1 (DENV-1), dengue virus serotype 2 (DENV-2), dengue virus serotype 3 (DENV-3), dengue virus serotype 4 (DENV-4) and dengue virus serotype 5 (DENV-5).

According to a preferred embodiment, the artificial nucleic acid, preferably the coding region of the artificial nucleic acid, comprises or consists of a nucleic acid sequence that is derived from a YFV selected from the group consisting of viruses listed in the following, with NCBI Taxonomy ID ("NCBI-ID") and/or UniprotKB/Swiss Prot/Genbank ID ("GB-ID") provided below: YFV 17D (NCBI-ID: 11090; GB-ID:P03314), YFV 1899/81 (NCBI-ID: 31641; GB-ID:P29165), YFV isolate Angola/14FA/1971 (NCBI-ID:407140; GB-ID:Q1X881), YFV isolate Ethiopia/Couma/1961 (NCBI-ID:407141; GB-ID:Q074N0), YFV isolate Ivory Coast/1999 (NCBI-ID:407136; GB-ID:Q6J3P1), YFV isolate Ivory Coast/85-82H/1982 (NCBI-ID: 407138; GB-ID:Q6J3P1), YFV isolate Uganda/A7094A4/1948 (NCBI-ID:407139; GB-ID:Q1X880), YFV strain French neurotropic vaccine (NCBI-ID:407135; GB-ID:Q89277), YFV strain Ghana/Asibi/1927 (NCBI-ID:407134; GB-ID:Q6DV88), and YFV Trinidad/79A/1979 (NCBI-ID:407137; GB-ID:Q9YRV3).

According to a preferred embodiment, the artificial nucleic acid, preferably the coding region of the artificial nucleic acid, comprises or consists of a nucleic acid sequence that is derived from a DENV selected from the group consisting of viruses listed in the following, with NCBI Taxonomy ID ("NCBI-ID") and/or UniprotKB/Swiss Prot/Genbank ID ("GB-ID") provided below: DENV 1 (NCBI-ID:11053), e.g. DENV 1 CYD23 (derived from a strain isolated from a subject of Sanofi Pasteur CYD23 clinical trial (D1-CYD23)), DENV 1 Brazil/97-11/1997 (NCBI-ID:408685; GB-ID:P27909), DENV 1 Jamaica/ CV1636/1977 (NCBI-ID:11058; GB-ID:P27913), DENV 1 Nauru/West Pac/1974 (NCBI-ID:11059; GB-ID:P17763), DENV 1 Singapore/S275/1990 (NCBI-ID:33741; GB-ID: P33478), DENV 1 Thailand/AHF 82-80/1980 (NCBI-ID: 11057); DENV 2 (NCBI-ID:11060), e.g. DENV LAV-2 (lab strain CYD2-T; GB-ID:AAB58783.1), DENV 2 16681-PDK53 (NCBI-ID:31635; GB-ID:P29991), DENV 2 China/ D2-04 (NCBI-ID:31636; GB-ID:P30026), DENV 2 Jamaica/1409/1983 (NCBI-ID:11064; GB-ID:P07564), DENV 2 Malaysia M2 (NCBI-ID:11062; GB-ID:P14338), DENV 2 Malaysia M3 (NCBI-ID:11063; GB-ID:P14339), DENV 2 Peru/IQT2913/1996 (NCBI-ID:408694; GB-ID: Q9WDA6), DENV 2 Puerto Rico/PR159-S1/1969 (NCBI-ID:11066; GB-ID:P12823), DENV 2 Thailand/0168/1979 (NCBI-ID:413041; GB-ID:P14337), DENV 2 Thailand/ 16681/84 (NCBI-ID:31634; GB-ID:P29990), DENV 2 Thailand/NGS-C/1944 (NCBI-ID:11065; GB-ID:P14340), DENV 2 Thailand/PUO-218/1980 (NCBI-ID:11068; GB-ID:P18356), DENV 2 Thailand/TH-36/1958 (NCBI-ID: 31637; GB-ID:P29984), DENV 2 Tonga/EKB194/1974 (NCBI-ID:11067; GB-ID:P27914); DENV 3 (NCBI-ID: 11053), e.g. DENV 3 NI/BID-V5099/2009 strain (D3 Cons; GenBank:AEE99028.1), DENV 3 China/80-2/1980 (NCBI-ID:408690; GB-ID:Q99D35), DENV 3 Martinique/1243/ 1999 (NCBI-ID:408691; GB-ID: Q6YMS3), DENV 3 Philippines/H87/1956 (NCBI-ID: 408870; GB-ID: P27915), DENV 3 Singapore/8120/1995 (NCBI-ID:408693; GB-ID: Q5UB51), DENV 3 Sri Lanka/1266/2000 (NCBI-ID: 408692; GB-ID:Q6YMS4); DENV 4 (NCBI-ID:11070), e.g. DENV 4 US/BID-V2440/1996 strain (D4 Cons; GB-ID: FJ850058; AC006146.1), DENV 4 Dominica/814669/1981 (NCBI-ID:408871; GB-ID:P09866), DENV 4 Philippines/ H241/1956 (NCBI-ID:408686; GB-ID:Q58HT7), DENV 4 Singapore/8976/1995 (NCBI-ID:408687; GB-ID: Q5UCB8), DENV 4 Thailand/0348/1991 (NCBI-ID: 408688; GB-ID:Q2YHFO), DENV 4 Thailand/0476/1997 (NCBI-ID:408689; GB-ID:Q2YHF2).

The at least one polypeptide encoded by the at least one coding region of the artificial nucleic acid comprises or consists of at least one flavivirus protein, such as a YFV protein or a DENV protein, or a fragment or variant thereof.

The RNA genome of a flavivirus, such as YFV or DENV, typically encodes a plurality of structural and non-structural proteins. Translation of viral RNA typically leads to a precursor protein comprising a plurality of individual viral (structural and non-structural) proteins (or precursor of these proteins) in one polypeptide chain, which is typically referred to as "polyprotein" or "precursor protein".

For example, a YFV polyprotein from YFV strain 17D preferably comprises or consists of an aa ("aa") sequence according to SEQ ID NO: 23 or an aa sequence according to GenBank-ID NP_041726.1.

In the context of the present invention, a flavivirus polyprotein, such as a YFV polyprotein or a DENV polyprotein, typically comprises amino acid (aa) sequences that are target sites for enzymes, which specifically cleave the polyprotein in order to yield fragments of the polyprotein, wherein the fragments preferably comprise or consist of an individual flavivirus protein or two or more flavivirus proteins, or a fragment or variant thereof. In the context of the present invention, the term "polyprotein" may also refer to a polypeptide chain comprising or consisting of the aa sequences of at least two individual flavivirus proteins, e.g. at least two individual YFV proteins or at least two individual DENV proteins, or a fragment or variant thereof. Cleavage of a flavivirus polyprotein preferably occurs between individual flavivirus proteins (e.g. between the capsid protein (C) and the premembrane protein (prM)), or fragments or variants thereof. An individual flavivirus protein, or a fragment or variant thereof, e.g. as obtained from a polyprotein by cleavage, is preferably referred to as "mature" flavivirus protein (e.g. a mature YFV protein or a mature DENV protein). In the context of the present invention, the term "mature flavivirus protein" is not limited to an individual flavivirus protein, or a fragment or variant thereof, which was generated by cleavage of a polyprotein, but also comprises an individual flavivirus protein produced by any other means, such as an individual flavivirus protein expressed recombinantly from an artificial nucleic acid. Preferably, a mature flavivirus protein lacks an aa sequence that is typically present in a corresponding aa sequence encoding said flavivirus protein in a flavivirus polyprotein (precursor protein) and wherein said aa sequence lacking in the mature flavivirus protein preferably corresponds to an aa sequence, which is usually removed by cleavage during processing of the flavivirus polyprotein. For example, an aa sequence, which is a target site for a protease, may be present in a flavivirus polyprotein, but may be absent from a mature flavivirus protein derived from said flavivirus polyprotein.

The term "flavivirus protein" (or "YFV protein" or "DENV protein") as used herein typically refers to an individual structural or non-structural flavivirus protein, such as a YFV or a DENV protein. For example, a flavivirus protein in the meaning of the present invention may be a protein selected from the group consisting of capsid protein (C), premembrane protein (prM), premembrane envelope protein (prME), peptide pr (pr), membrane protein (M), envelope protein (E) and a non-structural protein (NS).

As used herein, the term "flavivirus protein" (or "YFV protein" or "DENV protein") may also refer to an aa sequence corresponding to an individual flavivirus protein as present in a flavivirus polyprotein (precursor protein). Said aa sequence in the polyprotein may differ from the aa sequence of the respective mature flavivirus protein (i.e. after cleavage/processing the polyprotein). For example, the corresponding aa sequence comprised in the polyprotein may comprise aa residues that are removed during cleavage/ processing of the polyprotein (such as a signal sequence or a target site for a protease) and that are no longer present in the respective mature flavivirus protein. In the context of the present invention, the term "flavivirus protein" (or "YFV protein" or "DENV protein") comprises both, the precursor aa sequence comprised in a flavivirus polyprotein (i.e. as part of a polypeptide chain optionally further comprising other viral proteins) as well as the respective mature individual flavivirus protein. For example, the term "flavivirus capsid protein (C)" (or "YFV capsid protein (C)" or "DENV capsid protein (C)") as used herein may refer to an aa sequence in a flavivirus polyprotein corresponding to the precursor sequence of flavivirus capsid protein (C) (comprising, for example, a (C-terminal) signal sequence) as present in a flavivirus polyprotein as well as to a mature (separate) flavivirus capsid protein (C) (no longer comprising, for example, a (C-terminal) signal sequence).

In the context of the present invention, the term "flavivirus protein" (or "YFV protein" or "DENV protein") may also refer to a flavivirus polyprotein or, more preferably to a fragment of a flavivirus polyprotein, such as a flavivirus prME (e.g. a YFV prME or a DENV prME) or a flavivirus ME (e.g. a YFV ME or a DENV ME) protein. In this context, the term "flavivirus prME protein" (or "YFV prME protein" or "DENV prME protein") thus refers to a protein comprising an aa sequence corresponding to flavivirus prME protein as comprised in a flavivirus polyprotein, or to a fragment or variant of a flavivirus prME protein as comprised in a flavivirus polyprotein. Hence, a prME protein as used herein does not necessarily comprise full-length peptide pr, full-length M protein and full-length E protein, but preferably comprises at least a fragment of each of pr, M and E protein. The same holds for the term "ME protein" as used herein.

Also where reference is made herein to individual flavivirus proteins, such as to a "(flavivirus) envelope (E) protein", said protein does not necessarily comprise the full-length aa sequence of said flavivirus protein, but may preferably comprise a fragment or a variant thereof. For example, as used herein the term "(flavivirus) envelope (E) protein" also comprises truncated versions of a flavivirus E protein or flavivirus E proteins containing deletions. As used herein, the term "(flavivirus) envelope (E) protein" may thus also refer to a soluble variant of a flavivirus E protein (solE), such as a flavivirus E protein lacking the transmembrane domain. Furthermore, where reference is made herein to a flavivirus protein, such as to a "(flavivirus) envelope (E) protein" or to a "(flavivirus) prME protein", said protein may also comprise an aa sequence that is not derived from a flavivirus protein (e.g. a heterologous aa sequence). Moreover, where reference is made to an individual flavivirus protein (comprised in the at least one polypeptide) encoded by the artificial nucleic acid, it may also comprise fragments of other flavivirus proteins (that may also be comprised in the at least one encoded polypeptide). For example, it may be referred to herein to a "(flavivirus) envelope protein" (optionally comprised in the encoded polypeptide), wherein that term may refer not only to an aa sequence derived from an envelope protein, but may further also comprise an aa sequence derived from other (flavivirus) proteins, such as an aa sequence derived from a flavivirus capsid protein (or a fragment thereof) or derived from a flavivirus nonstructural protein (or a fragment thereof). The term "flavivirus protein" thus preferably refers to an individual flavivirus protein, or a fragment or variant thereof, which further comprises an aa sequence, which is not derived from that individual flavivirus protein, but preferably from another flavivirus protein or from a heterologous aa sequence.

Where reference is made to aa residues and their position in a flavivirus protein or in a flavivirus polyprotein, any numbering used herein—unless stated otherwise—relates to the position of the respective aa residue in a flavivirus polyprotein (precursor protein), wherein position "1" corresponds to the first aa residue, i.e. the aa residue at the N-terminus of a flavivirus polyprotein. More preferably, the numbering with regard to aa residues refers to the respective position of an aa residue in a flavivirus polyprotein, which is preferably derived from a YFV or a DENV as described herein.

In the following the aa regions of YFV proteins and fragments are indicated herein including the respective aa position in the YFV 17D polyprotein. The following abbreviations are used herein with reference to YFV proteins throughout the specification (including information provided under the identifier <223> of the sequence listing): C: capsid protein C (e.g. aa 1-101); X: fragment of capsid protein C (N-terminal overhang, e.g. aa 92-101); SS: ER anchor/signal sequence (SS) for the capsid protein C (e.g. aa 102-121); pr: peptide pr (e.g. aa 122-210); M: matrix protein M (e.g. aa 211-285); prM: premembrane protein prM (e.g. aa 122-285); E: envelope protein E (e.g. aa 286-778); prME: premembrane envelope protein prME (e.g. aa 122-778); XX: fragment of non-structural protein NS1 (C-terminal overhang, e.g. aa 779-788); NS1: non-structural protein 1 (e.g. aa 779-1130); NS2A: non-structural protein 2A (e.g. aa 1131-1354); NS2B: non-structural protein 2B (e.g. aa 1355-1484); NS3: non-structural protein 3 (e.g. aa 1485-2107); NS4A: non-structural protein 4A (e.g. aa 2108-2233); P2K: Peptide 2k (e.g. aa 2234-2256); NS4B: non-structural protein 4B (e.g. aa 2257-2506); NS5: non-structural protein 5 (e.g. aa 2507-3411).

The following abbreviations for heterologous elements are used throughout the specification that may be part of YFV proteins of the invention (including information provided under the identifier <223> of the sequence listing): IntFlag: internal flag tag located in the E protein to facilitate the convenient detection of E protein expression via anti flag tag antibodies; TMcFlag: Flag tag located in the transmembrane domain of the E protein to facilitate the convenient detection of E protein expression via anti flag tag antibodies.

In the following the aa regions of DENV proteins and fragments are indicated herein including the respective aa position in the respective DENV polyprotein (DENV-1, DENV-2, DENV-3, DENV-4) if not stated otherwise. The following abbreviations are used herein with reference to DENV proteins throughout the specification (including information provided under the identifier <223> of the sequence listing): C: capsid protein C (e.g. DENV-1: aa 1-100, DENV-2: aa 1-100, DENV-3: aa 1-100, DENV-4: aa 1-99); SSc: ER anchor/signal sequence for the capsid protein C (e.g. DENV-1: aa 101-114, DENV-2: aa 101-114, DENV-3: aa 101-114, DENV-4: aa 100-113); SSm: signal sequence derived from the matrix protein M (C-terminal part of the M protein with additional start codon; e.g. DENV-1: aa 263-280, DENV-2: aa 263-280, DENV-3: aa 263-280, DENV-4: aa 262-279); SSopt: optimized signal sequence derived from SSc; pr: peptide pr (e.g. DENV-1: aa 115-205, DENV-2: aa 115-205, DENV-3: aa 115-205, DENV-4: aa 114-204); M: matrix protein M (e.g. DENV-1: aa 206-280, DENV-2: aa 206-280, DENV-3: aa 206-280, DENV-4: aa 205-279); pr(D104A): peptide pr with a point mutation in the furin cleavage site between the peptide pr and the M protein (indicated aa in respect of DENV-3 peptide pr); prM: premembrane protein prM (e.g. DENV-1: aa 115-280, DENV-2: aa 115-280, DENV-3: aa 115-280, DENV-4: aa 114-279); E: envelope protein E (e.g. DENV-1: aa 281-775, DENV-2: aa 281-775, DENV-3: aa 281-773, DENV-4: aa 280-774); prME: premembrane envelope protein prME (e.g. DENV-1: aa 115-775, DENV-2: aa 115-775, DENV-3: aa 115-773, DENV-4: aa 114-774); STEM_TM: stem/transmembrane region of the envelope protein E (e.g. DENV-1: aa 675-775, DENV-2: aa 675-775, DENV-3: aa 673-773, DENV-4: aa 674-774); TM: transmembrane region of envelope protein E (e.g. DENV-1: aa 705-775, DENV-2: aa 705-775, DENV-3: aa 703-773, DENV-4: aa 704-774); E(A265T): envelope protein E with a mutation A265T in the E protein-M protein "latch" (indicated aa in respect of DENV-3 E protein, DENV-1, DENV-2 and DENV-4: e.g. E(A267T)); E(F108S): envelope protein E with a mutation (F108S) in the fusion loop (indicated aa in respect of DENV-3 E protein); E(G28C), (H242C): envelope protein E with two mutations G28C and H242C for introducing a disulphide bond to stabilize the E protein dimer (indicated amino acid residues (aas) in respect of DENV-3 E protein); E(H149N): envelope protein E with a mutation H149N of a protonable residue in the fusion loop to stabilize the pre-fusion conformation (indicated aa in respect of DENV-3 E protein); E(H259N): envelope protein E with a mutation H259N of a protonable residue in the fusion loop to stabilize the pre-fusion conformation (indicated aa in respect of DENV-3 E protein, DENV-1, DENV-2 and DENV-4: e.g. E(H261N)); E(H259R): envelope protein E with a mutation H259R in the stem/M latch to stabilize the pre-fusion conformation (indicated aa in respect of DENV-3 E protein); E(H27N): envelope protein E with a mutation H27N of a protonable residue in the fusion loop to stabilize the pre-fusion conformation (indicated aa in respect of DENV-3 E protein); E(K110E): envelope protein E with a mutation K110E in the fusion loop to stabilize the pre-fusion conformation (indicated aa in respect of DENV-3 E protein); E(K321T): envelope protein E with a mutation K321T in the fusion loop to stabilize the pre-fusion conformation (indicated aa in respect of DENV-3 E protein); E(M258L): envelope protein E with a mutation M258L in the stem/M latch to stabilize the pre-fusion conformation (indicated aa in respect of DENV-3 E protein); E(N240S): envelope protein E with a mutation N240S in the fusion loop to stabilize the pre-fusion conformation (indicated aa in respect of DENV-3 E protein); E(N89D): envelope protein E with a mutation N89D in the fusion loop to stabilize the pre-fusion conformation (indicated aa in respect of DENV-3 E protein); E(R186L): envelope protein E with a mutation R186L in the domain I-II hinge region to stabilize the pre-fusion conformation (indicated aa in respect of DENV-3 E protein, DENV-1, DENV-2 and DENV-4: e.g. E(R188L)); E(R186L), (A265T): envelope protein E with a mutation R186L (as defined above) and a mutation (A265T) (as defined above); E(R99P), (F108N): envelope protein E with two mutations R99P and F108N to optimize the b-turn (indicated aas in respect of DENV-3 E protein); E(S184F): envelope protein E with a mutation S184F in the hinge region to stabilize the pre-fusion conformation (indicated aa in respect of DENV-3 E protein, DENV-1 and DENV-2: e.g. E(S186F), DENV-4: e.g. E(E186F)); E(S296G): envelope protein E with a mutation S296G in the hinge region to stabilize the pre-fusion conformation (indicated aa in respect of DENV-3 E protein); E(S311R): envelope protein E with a mutation S311R in the fusion loop to stabilize the pre-fusion conformation (indicated aa in respect of DENV-3 E protein); E(T76I): envelope protein E with a mutation T76I in the fusion loop to stabilize the pre-fusion conformation (indicated aa in respect of DENV-3 E protein); E(Y96H): envelope protein E with a mutation Y96H in the fusion loop to stabilize the pre-fusion conformation (indicated aa in respect of DENV-3 E protein, DENV-1: e.g. E(F96H), DENV-2: e.g. E(M96H), DENV-4: e.g. E(V96H)); Edel101-107: envelope protein E with indicated deletion (indicated aa region in respect of DENV-3 E protein); Edelstem_TM: envelope protein E lacking the stem/transmembrane region (e.g. DENV-1: aa 281-674, DENV-2: aa 281-674, DENV-3: aa 281-672, DENV-4: aa 280-673); EdelTM: envelope protein E lacking the transmembrane region (e.g. DENV-1: aa 281-704, DENV-2: aa 281-704, DENV-3: aa 281-702, DENV-4: aa 280-703); Edelstem_TM, (H259N): envelope protein E lacking the stem/transmembrane region (as defined above) with a mutation H259N (as defined above); Edelstem_TM, (R186L),(A265T): envelope protein E lacking the stem/transmembrane region (as defined above) with a mutation R186L (as defined above) and a mutation A265T (as defined above); Edelstem_TM, (F108S): envelope protein E lacking the stem/transmembrane region with a mutation F108S (as defined above); E(F108S), (R186L), (A265T): envelope protein E with a mutation F108S, R186L, and A265T (mutations as defined above); Edel101-

107, (R99P), (F108N): envelope protein E with a deletion 101-107 (as defined above) and mutation R99P and F108N (mutations as defined above); Edelstem_TM,del101-107, (R99P), (F108N): envelope protein E lacking the stem/transmembrane region (as defined above) with a deletion 101-107 (as defined above) and mutation R99P (as defined above) and F108N (as defined above); NS1: non-structural protein 1 (e.g. DENV-1: aa 776-1127, DENV-2: aa 776-1127, DENV-3: aa 774-1125, DENV-4: aa 775-1126); NS2A: non-structural protein 2A (e.g. DENV-1: aa 1128-1345, DENV-2: aa 1128-1345, DENV-3: aa 1126-1343, DENV-4: aa 1127-1344); NS2B: non-structural protein 2B (e.g. DENV-1: aa 1346-1475, DENV-2: aa 1346-1475, DENV-3: aa 1344-1473, DENV-4: aa 1345-1474); NS3: non-structural protein 3 (e.g. DENV-1: aa 1476-2094, DENV-2: aa 1476-2093, DENV-3: aa 1474-2092, DENV-4: aa 1475-2092); NS4A: non-structural protein 4A (e.g. DENV-1: aa 2095-2221, DENV-2: aa 2094-2220, DENV-3: aa 2093-2219, DENV-4: aa 2093-2219); P2K: Peptide 2k (e.g. DENV-1: aa 2222-2244, DENV-2: aa 2221-2243, DENV-3: aa 2220-2242, DENV-4: aa 2220-2242); NS4B: non-structural protein 4B (e.g. DENV-1: aa 2245-2493, DENV-2: aa 2244-2491, DENV-3: aa 2243-2490, DENV-4: aa 2243-2487); NS5: non-structural protein 5 (e.g. DENV-1: aa 2494-3392, DENV-2: aa 2492-3391, DENV-3: aa 2491-3390, DENV-4: aa 2488-3387).

The following abbreviations for heterologous elements that may be part of flavivirus proteins, in particular of DENV proteins of the invention are used throughout the specification (including information provided under the identifier <223> of the sequence listing): Ferritin: aa 5-167 of ferritin from *Helicobacter pylori* (GenBank NP_223316.1 with a point mutation (N19Q)); JEV: aa 400-500 (stem region) of the Japanese encephalitis virus envelope protein E; Linker: peptide linker SGG or G4SG4; P2A or F2A: self-cleaving 2A peptide from Foot-and-mouth disease virus (FMDV). In the Dengue polyprotein the mature form of the capsid protein is generated upon posttranslational removal of the C-terminal hydrophobic signal sequence by the virally encoded NS2B-NS3 protease. Instead of co-expressing of the viral protease the 2A peptide of Foot-and-mouth disease virus (FMDV) may be suitably used; SStPA: human tissue plasminogen activator signal peptide; WHbcAg: aa 1-149 (with C-terminal cysteine) of Woodchuck hepatitis B virus core antigen.

In some embodiments described herein, the at least one polypeptide encoded by the at least one coding region of the artificial nucleic acid may comprise or consist of at least one individual flavivirus protein (e.g. a YFV protein or a DENV protein), the aa sequence of which does typically not comprise an N-terminal methionin residue. It is thus understood that the phrase "polypeptide consisting of (at least one) flavivirus protein . . . " relates to a polypeptide comprising the aa sequence of said flavivirus protein(s) and—if the aa sequence of the respective flavivirus protein(s) does not comprise such an N-terminal methionin residue—an N-terminal methionin residue.

According to certain embodiments, the present invention concerns an artificial nucleic acid as described herein encoding at least one polypeptide comprising or consisting of a flavivirus polyprotein, an individual or a mature flavivirus protein, or a fragment or variant thereof.

In a preferred embodiment, the at least one encoded polypeptide comprises or consists of at least one flavivirus protein, wherein the flavivirus protein comprises or consists of at least one aa sequence according to any one of SEQ ID NO: 23-56, 541-586, 963-1106, 2640-5273, 26346 or 955-

962, or a fragment or variant of any one of these aa sequences. Additional information regarding each of these aa sequences may also be derived from the sequence listing, in particular from the details provided therein under numeric identifier <223>, which has to be understood as part of the disclosure of the present invention. All particularly suitable nucleic acid sequences relating to any one of aa sequences SEQ ID NO: 23-56, 541-586, 963-1106, 2640-5273, 26346 or 955-962 can also be derived from the sequence listing using information provided in the ST25 sequence listing under numeric identifier <223> as explained in the following.

For example, the numeric identifier <223> in the sequence listing of SEQ ID NO: 48 reads as follows: "derived and/or modified protein sequence (wt) from YFV 17D__NC_002031.1__X-SS-prME-XX". It has to be noted that throughout the sequence listing, information provided under numeric identifier <223> follows the same structure: "<SEQUENCE_DESCRIPTOR> from <CONSTRUCT_IDENTIFIER>".

The <SEQUENCE_DESCRIPTOR> relates to the type of sequence (e.g., "derived and/or modified protein sequence", "derived and/or modified CDS", "mRNA product Design1 comprising derived and/or modified sequence", or "mRNA product Design2 comprising derived and/or modified sequence") and whether the sequence comprises or consists of a wild type sequence ("wt") or comprises or consists of a sequence-optimized sequence (e.g. "opt1", "opt2", "opt3", "opt4", "opt5", "opt6", "opt11"; sequence optimizations are described in further detail below in paragraph "G/C content modification").

The <CONTRUCT_IDENTIFIER> provided under numeric identifier <223> has the following structures: ("organism"_"construct name", or "organism"__"accession number"__"construct name") and is intended to help the person skilled in the art to explicitly derive suitable nucleic acid sequences (e.g., RNA, mRNA) encoding the same DENV or YFV polyprotein according to the invention. For example, the <CONSTRUCT_IDENTIFIER> provided under numeric identifier <223> of SEQ ID NO: 48 reads as follows: "YFV 17D__NC_002031.1_X-SS-prME-XX".

In that example, the respective protein sequence is derived from "YFV 17D" (organism) with the NCBI accession number "NC_002031.1", wherein the polyprotein comprises the structural elements "X-SS-prME-XX" (construct name). If the skilled person uses the construct identifier of SEQ ID NO: 48, namely "YFV 17D__NC_002031.1__X-SS-prME-XX", he easily arrives at the following list of SEQ ID NOs that he can retrieve from the sequence listing of the present invention without undue burden: SEQ ID NO: 48 (<223>: derived and/or modified protein sequence (wt) from YFV 17D__NC_002031.1__X-SS-prME-XX); SEQ ID NO: 82 (<223>: derived and/or modified CDS sequence (wt) from YFV 17D__NC_002031.1__X-SS-prME-XX); SEQ ID NO: 120 (<223>: derived and/or modified CDS sequence (opt1) from YFV 17D__NC_002031.1_X-SS-prME-XX); SEQ ID NO: 152 (<223>: derived and/or modified CDS sequence (opt1) from YFV 17D__NC_002031.1__X-SS-prME-XX); SEQ ID NO: 184 (<223>: derived and/or modified CDS sequence (opt2) from YFV 17D__NC_002031.1__X-SS-prME-XX; SEQ ID NO: 216 (<223>: derived and/or modified CDS sequence (opt3) from YFV 17D__NC_002031.1_X-SS-prME-XX); SEQ ID NO: 248 (<223>: derived and/or modified CDS sequence (opt4) from YFV 17D__NC_002031.1__X-SS-prME-XX); SEQ ID NO: 280 (<223>: derived and/or modified CDS sequence (opt5) from YFV 17D__NC_002031.1__X-SS-prME-XX);

SEQ ID NO: 312 (<223>: derived and/or modified CDS sequence (opt6) from YFV 17D__NC_002031.1__X-SS-prME-XX); SEQ ID NO: 344 (<223>: derived and/or modified CDS sequence (opt11) from YFV 17D__NC_002031.1__X-SS-prME-XX); SEQ ID NO: 360 (<223>: derived and/or modified CDS sequence (opt16) from YFV 17D__NC_002031.1__X-SS-prME-XX); SEQ ID NO: 372 (<223>: derived and/or modified CDS sequence (opt17) from YFV 17D__NC_002031.1_X-SS-prME-XX); SEQ ID NO: 378 (<223>: mRNA product Design1 comprising derived and/or modified sequence from YFV 17D__NC_002031.1__X-SS-prME-XX (CDS wt) R2387); SEQ ID NO: 386 (<223>: mRNA product Design1 comprising derived and/or modified sequence from YFV 17D__NC_002031.1__X-SS-prME-XX (CDS opt1) R2388); SEQ ID NO: 396 (<223>: mRNA product Design1 comprising derived and/or modified sequence from YFV 17D__NC_002031.1__X-SS-prME-XX (CDS opt1)); SEQ ID NO: 404 (<223>: mRNA product Design1 comprising derived and/or modified sequence from YFV 17D__NC_002031.1__X-SS-prME-XX (CDS opt2)); SEQ ID NO: 412 (<223>: mRNA product Design1 comprising derived and/or modified sequence from YFV 17D__NC_002031.1_X-SS-prME-XX (CDS opt3)); SEQ ID NO: 420 (<223>: mRNA product Design1 comprising derived and/or modified sequence from YFV 17D__NC_002031.1__X-SS-prME-XX (CDS opt4)); SEQ ID NO: 428 (<223>: mRNA product Design1 comprising derived and/or modified sequence from YFV 17D__NC_002031.1_X-SS-prME-XX (CDS opt5); SEQ ID NO: 436 (<223>: mRNA product Design1 comprising derived and/or modified sequence from YFV 17D__NC_002031.1__X-SS-prME-XX (CDS opt6)); SEQ ID NO: 444 (<223>: mRNA product Design1 comprising derived and/or modified sequence from YFV 17D__NC_002031.1__X-SS-prME-XX (CDS opt11)); SEQ ID NO: 451 (<223>: mRNA product Design1 comprising derived and/or modified sequence from YFV 17D__NC_002031.1_X-SS-prME-XX (CDS opt16)); SEQ ID NO: 456 (<223>: mRNA product Design1 comprising derived and/or modified sequence from YFV 17D__NC_002031.1__X-SS-prME-XX (CDS opt17) R2401); SEQ ID NO: 462 (<223>: mRNA product Design2 comprising derived and/or modified sequence from YFV 17D__NC_002031.1__X-SS-prME-XX (CDS wt)); SEQ ID NO: 470 (<223>: mRNA product Design2 comprising derived and/or modified sequence from YFV 17D__NC_002031.1_X-SS-prME-XX (CDS opt1) R2581/R2582); SEQ ID NO: 478 (<223>: mRNA product Design2 comprising derived and/or modified sequence from YFV 17D__NC_002031.1_X-SS-prME-XX (CDS opt1)); SEQ ID NO: 486 (<223>: mRNA product Design2 comprising derived and/or modified sequence from YFV 17D__NC_002031.1__X-SS-prME-XX (CDS opt2)); SEQ ID NO: 494 (<223>: mRNA product Design2 comprising derived and/or modified sequence from YFV 17D__NC_002031.1__X-SS-prME-XX (CDS opt3)); SEQ ID NO: 502 (<223>: mRNA product Design2 comprising derived and/or modified sequence from YFV 17D__NC_002031.1_X-SS-prME-XX (CDS opt4)); SEQ ID NO: 510 (<223>: mRNA product Design2 comprising derived and/or modified sequence from YFV 17D__NC_002031.1__X-SS-prME-XX (CDS opt5)); SEQ ID NO: 518 (<223>: mRNA product Design2 comprising derived and/or modified sequence from YFV 17D__NC_002031.1_X-SS-prME-XX (CDS opt6)); SEQ ID NO: 526 (<223>: mRNA product Design2 comprising derived and/or modified sequence from YFV 17D_NC_002031.1_X-SS-prME-XX (CDS opt11)); SEQ ID NO: 533 (<223>: mRNA product Design2 comprising derived and/or modified sequence from YFV 17D_NC_002031.1_X-SS-prME-XX (CDS opt16)); SEQ ID NO: 538 (<223>: mRNA product Design2 comprising derived and/or modified sequence from YFV 17D_NC_002031.1_X-SS-prME-XX (CDS opt17)).

A similar approach can be applied for all other DENV or YFV sequences disclosed in the sequence listing and their respective "construct identifier" as specified above can be used to retrieve nucleic acid sequences or amino acid sequences that belong to the same constructs.

In the context of the present invention, a "fragment" of an aa sequence, such as a (poly)peptide or a protein, e.g. the at least one flavivirus protein as described herein, may typically comprise or consist of an aa sequence of a protein or peptide as defined herein, which is, with regard to its aa sequence (or the respective coding nucleic acid), N-terminally and/or C-terminally truncated compared to the aa sequence of the original (native) protein (or respective coding nucleic acid). Such truncation may thus occur either on the aa level or correspondingly on the nucleic acid level. A sequence identity with respect to such a fragment as defined herein may therefore preferably refer to the entire protein or peptide as defined herein or to the entire (coding) nucleic acid of such a protein or peptide.

Preferably, a fragment of an aa sequence in the context of the present invention, comprises or consists of a continuous stretch of aa residues corresponding to a continuous stretch of aa residues in the molecule the fragment is derived from, which represents at least 5%, 10%, 20%, 30%, 40%, 50%, 60%, preferably at least 70%, more preferably at least 80%, even more preferably at least 90%, even more preferably at least 95%, most preferably at least 99%, of the total (i.e. full-length) protein, from which the fragment is derived. More preferably, a fragment of an aa sequence as used herein is at least 5%, 10%, 20%, 30%, 40%, 50%, 60%, preferably at least 70%, more preferably at least 80%, even more preferably at least 90%, even more preferably at least 95%, most preferably at least 99%, identical to an aa sequence, from which it is derived. Preferably, a fragment as used herein has the same biological function or specific activity compared to the full-length protein. More preferably, a fragment of a (flavivirus) protein as described herein comprises at least one epitope. According to a preferred embodiment, a fragment of a (flavivirus) protein as described herein, which preferably comprises at least on epitope, has an antigenic property.

In the context of the present invention, a fragment of a protein or of a peptide may furthermore comprise or consist of an aa sequence of a protein or peptide as defined herein, such as a flavivirus protein, which has a length of for example at least 5 aa residues, preferably a length of at least 6 aa residues, preferably at least 7 aa residues, more preferably at least 8 aa residues, even more preferably at least 9 aa residues; even more preferably at least 10 aa residues; even more preferably at least 11 aa residues; even more preferably at least 12 aa residues; even more preferably at least 13 aa residues; even more preferably at least 14 aa residues; even more preferably at least 15 aa residues; even more preferably at least 16 aa residues; even more preferably at least 17 aa residues; even more preferably at least 18 aa residues; even more preferably at least 19 aa residues; even more preferably at least 20 aa residues; even more preferably at least 25 aa residues; even more preferably at least 30 aa residues; even more preferably at least 35 aa residues; even more preferably at least 50 aa residues; or most preferably at least 100 aa residues. For example such fragment may have a length of about 6 to about 20 or even more aa residues, e.g. fragments as processed and presented by MHC class I molecules, preferably having a length of about 8 to about 10 aa residues, e.g. 8, 9, or 10, (or even 6, 7, 11, or 12 aa residues), or fragments as processed and presented by MHC class II molecules, preferably having a length of about 13 or more aa residues, e.g. 13, 14, 15, 16, 17, 18, 19, 20 or even more aa residues, wherein these fragments may be selected from any part of the aa sequence. These fragments are typically recognized by T-cells in form of a complex consisting of the peptide fragment and an MHC molecule, i.e. the fragments are typically not recognized in their native form. Fragments of proteins or peptides may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

In some embodiments, the artificial nucleic acid may encode at least one polypeptide comprising or consisting of a variant of a flavivirus protein. In this context, a "variant" of a protein or a peptide may comprise or consist of an aa sequence, which differs from the original sequence in one or more mutation(s), such as one or more substituted, inserted and/or deleted amino acids. Preferably, these variants have the same biological function or specific activity compared to the full-length native protein, e.g. its specific antigenic property. "Variants" of proteins or peptides as defined in the context of the present invention may comprise conservative aa substitution(s) compared to their native, i.e. non-mutated physiological, sequence. Those aa sequences as well as their encoding nucleotide sequences in particular fall under the term variants as defined herein. Substitutions in which aas, which originate from the same class, are exchanged for one another are called conservative substitutions. In particular, these are aas having aliphatic side chains, positively or negatively charged side chains, aromatic groups in the side chains or amino acids, the side chains of which can enter into hydrogen bridges, e.g. side chains which have a hydroxyl function. This means that e.g. an aa having a polar side chain is replaced by another aa having a likewise polar side chain, or, for example, an aa characterized by a hydrophobic side chain is substituted by another aa having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam).

A variant of an aa sequence as used herein typically differs from the original sequence in one or more residues, such as one or more substituted, inserted and/or deleted aa residues. Preferably, these variants have the same biological function or specific activity compared to the full-length peptide or protein, from which they are derived. More preferably, a variant of a (flavivirus) protein as described herein, has an antigenic property. In the context of the present invention, a variant of an aa sequence is preferably at least 5%, 10%, 20%, 30%, 40%, 50%, 60%, more preferably at least 70%, even more preferably at least 80%, even more preferably at least 90%, even more preferably at least 95%, most preferably at least 99%, identical to a reference aa sequence. It is further preferred that a "variant" as used herein comprises or consists of a continuous stretch of aa residues, corresponding to a continuous stretch of aa residues in the reference aa sequence, which represents at least 5%, 10%, 20%, 30%, 40%, 50%, 60%, preferably at least 70%, more preferably at least 80%, even more preferably at least 90%, even more preferably at least 95%, most preferably at least 99%, of the total (i.e. full-length) reference molecule. In the context of the present invention, a "variant" of a protein or peptide may preferably have at least 70%, 75%, 80%, 85%, 90%, 95%, 98% or 99% sequence identity over a stretch of at least 10, at least 20, at least 30, at least 50, at least 75 or at least 100 aa residues of such protein or peptide.

Furthermore, variants of proteins or peptides as defined herein, which may be encoded by a nucleic acid, may also comprise those sequences, wherein nucleotides of the encoding nucleic acid sequence are exchanged according to the degeneration of the genetic code, without leading to an alteration of the respective aa sequence of the protein or peptide, i.e. the aa sequence or at least part thereof may not differ from the original sequence in one or more mutation(s) within the above meaning.

The description and the definitions provided above with regard to a fragment or a variant of a peptide or protein apply throughout the present application, where reference is made to a fragment or a variant of a peptide or protein, e.g. of a flavivirus protein.

According to certain embodiments, the artificial nucleic acid comprises or consists of a nucleic acid sequence encoding at least one polypeptide comprising or consisting of at least one aa sequence according to any one of SEQ ID NO: 23-56, 541-586, 963-1106, 2640-5273, 26346, 955-962, or a fragment or variant of any one of these aa sequences. It has to be understood that, on nucleic acid level, any nucleic acid sequence (e.g. DNA sequence, RNA sequence) which encodes an aa sequence being identical to SEQ ID NO: 23-56, 541-586, 963-1106, 2640-5273, 26346, 955-962 or fragments or variants thereof, or any nucleic acid sequence (e.g. DNA sequence, RNA sequence) which encodes aa sequences being at least 50%, 60%, 70%, 80%, 85%, 86%, 87%, 88%, 89%, 90%, 91%, 92%, 93%, 94%, 95%, 96%, 97%, 98%, or 99% identical to any one of SEQ ID NO: 23-56, 541-586, 963-1106, 2640-5273, 26346, 955-962 or fragments or variants thereof, may be selected and may accordingly be understood as suitable coding sequence and may therefore be comprised in the artificial nucleic acid of the invention.

Preferably, the artificial nucleic acid comprises or consists of at least one nucleic acid sequence according to any one of SEQ ID NO: 57-374, 587-954, 375-540, 1116-1259, 1268-1411, 1424-1567, 1576-1719, 1728-1871, 1880-2023, 2032-2175, 2184-2327, 2336-2479, 5274-26345, 2480-2639, 26347-26357, 1107-1115, 1260-1267, 1416-1423, 1568-1575, 1720-1727, 1872-1879, 2024-2031, 2176-2183, 2328-2335, or a fragment or variant of any one of these nucleic acid sequences. Additional information regarding each of these nucleic acid sequence may also be derived from the sequence listing, in particular from the details provided therein under identifier <223> (as explained above).

As used herein, a "fragment" of a nucleic acid sequence may typically comprise or consist of a nucleic acid sequence as defined herein, which is, with regard to its nucleic acid sequence 5'-terminally and/or 3'-terminally truncated compared to the nucleic acid sequence of the original nucleic acid. A sequence identity with respect to such a fragment as defined herein may therefore preferably refer to the entire (coding) nucleic acid of a protein or peptide as described herein.

Preferably, a fragment of a nucleic acid sequence in the context of the present invention, comprises or consists of a continuous stretch of nucleotides corresponding to a continuous stretch of nucleotides in the nucleic acid, the fragment is derived from, which represents at least 5%, 10%, 20%, 30%, 40%, 50%, 60%, preferably at least 70%, more preferably at least 80%, even more preferably at least 90%, even more preferably at least 95%, most preferably at least 99%, of the total (i.e. full-length) nucleic acid, from which the fragment is derived. More preferably, a fragment of a nucleic acid sequence as used herein is at least 5%, 10%, 20%, 30%, 40%, 50%, 60%, preferably at least 70%, more preferably at least 80%, even more preferably at least 90%, even more preferably at least 95%, most preferably at least 99%, identical to a nucleic acid sequence, from which it is derived. Preferably, a fragment as used herein has the same biological function or specific activity compared to the corresponding nucleic acid sequence in the full-length nucleic acid. In particular, it is preferred that a fragment of a nucleic acid encodes the same aa sequence as the corresponding nucleotides in the full-length nucleic acid, the fragment is derived from. Preferably, a fragment of a nucleic acid encodes a peptide or protein, preferably as defined as herein, which is at least 5%, 10%, 20%, 30%, 40%, 50%, 60%, preferably at least 70%, more preferably at least 80%, even more preferably at least 90%, even more preferably at least 95%, most preferably at least 99%, identical to the aa sequence encoded by the nucleic acid, from which the fragment is derived.

In a preferred embodiment, the term "fragment of a nucleic acid (sequence)" relates to a functional fragment, which typically has the same biological activity as the corresponding full-length nucleic acid (sequence). For example, if the full-length nucleic acid (sequence) has a catalytic or a regulatory activity (e.g. a histone stem-loop or an UTR element as described herein), a fragment thereof in the context of the present invention preferably has the same catalytic or regulatory activity.

In the context of the present invention, a fragment of a nucleic acid may furthermore comprise or consist of a nucleic acid sequence encoding a (fragment of a) protein or peptide as defined herein, such as a (fragment of a) flavivirus protein, which has a length of for example at least 5 aa residues, preferably a length of at least 6 aa residues, preferably at least 7 aa residues, more preferably at least 8 aa residues, even more preferably at least 9 aa residues; even more preferably at least 10 aa residues; even more preferably at least 11 aa residues; even more preferably at least 12 aa residues; even more preferably at least 13 aa residues; even more preferably at least 14 aa residues; even more preferably at least 15 aa residues; even more preferably at least 16 aa residues; even more preferably at least 17 aa residues; even more preferably at least 18 aa residues; even more preferably at least 19 aa residues; even more preferably at least 20 aa residues; even more preferably at least 25 aa residues; even more preferably at least 30 aa residues; even more preferably at least 35 aa residues; even more preferably at least 50 aa residues; or most preferably at least 100 aa residues. For example such (fragment of a) peptide or protein encoded by the fragment of a nucleic acid as described herein may have a length of about 6 to about 20 or even more aa residues, e.g. fragments as processed and presented by MHC class I molecules, preferably having a length of about 8 to about 10 aa residues, e.g. 8, 9, or 10, (or even 6, 7, 11, or 12 aa residues), or fragments as processed and presented by MHC class II molecules, preferably having a length of about 13 or more aa residues, e.g. 13, 14, 15, 16, 17, 18, 19, 20 or even more aa residues, wherein these fragments may be selected from any part of the aa sequence. In this context it is particularly preferred that the artificial nucleic acid encodes at least one epitope of a flavivirus protein.

In some embodiments, the artificial nucleic acid may comprise or consist of a variant of a nucleic acid sequence as described herein. In this context, a "variant" of a nucleic acid sequence may comprise or consist of an nucleic acid sequence, which differs from the original sequence in one or more mutation(s), such as one or more substituted, inserted and/or deleted nucleotide(s). In particular, the term "variant of a nucleic acid (sequence)" as used herein may comprise a nucleic acid sequence encoding a variant of a peptide or protein as described herein. Preferably, these variants have the same biological function or specific activity compared to the full-length nucleic acid, e.g. its specific protein coding capacity. More preferably, a variant of a nucleic acid encodes a peptide or protein, preferably as defined as herein, which is at least 5%, 10%, 20%, 30%, 40%, 50%, 60%, preferably at least 70%, more preferably at least 80%, even more preferably at least 90%, even more preferably at least 95%, most preferably at least 99%, identical to the aa sequence encoded by the nucleic acid, from which the variant is derived. "Variants" of nucleic acid sequences as defined in the context of the present invention may also encode conservative aa substitution(s) compared to their native, i.e. non-mutated physiological, sequence. Those nucleic acid sequences as well as their encoded aa sequences in particular fall under the term variants as defined herein. In this context, a variant of a nucleic acid sequence is preferably at least 5%, 10%, 20%, 30%, 40%, 50%, 60%, more preferably at least 70%, even more preferably at least 80%, even more preferably at least 90%, even more preferably at least 95%, most preferably at least 99%, identical to a reference nucleic acid sequence. It is further preferred that a "variant" as used herein comprises or consists of a continuous stretch of nucleotides, corresponding to a continuous stretch of nucleotides in the reference molecule, which represents at least 5%, 10%, 20%, 30%, 40%, 50%, 60%, preferably at least 70%, more preferably at least 80%, even more preferably at least 90%, even more preferably at least 95%, most preferably at least 99%, of the total (i.e. full-length) reference nucleic acid.

Furthermore, a variant of a nucleic acid sequence may also comprise those sequences, wherein nucleotides are exchanged according to the degeneration of the genetic code, without leading to an alteration of the respective aa sequence of the protein or peptide, i.e. the aa sequence or at least part thereof may not differ from the original sequence in one or more mutation(s) within the above meaning.

In a preferred embodiment, the term "variant of a nucleic acid (sequence)" relates to a functional variant, which typically has the same biological activity as the corresponding nucleic acid (sequence), from which the variant is derived. For example, if the nucleic acid (sequence) has a catalytic or a regulatory activity (e.g. a histone stem-loop or an UTR element as described herein), a variant thereof in the context of the present invention preferably has the same catalytic or regulatory activity.

The description and the definitions provided above with regard to a fragment or a variant of a nucleic acid sequence apply throughout the present application, where reference is made to a fragment or a variant of a nucleic acid sequence.

According to certain embodiments, the at least one coding region of the artificial nucleic acid comprises or consists of at least one nucleic acid sequence according to any one of SEQ ID NO: 57-374, 587-954, 1116-1259, 1268-1411, 1424-1567, 1576-1719, 1728-1871, 1880-2023, 2032-2175, 2184-2327, 2336-2479, 5274-26345, 26347-26355, 1107-1115, 1260-1267, 1416-1423, 1568-1575, 1720-1727, 1872-1879, 2024-2031, 2176-2183, 2328-2335, or a fragment or variant of any one of these nucleic acid sequences.

In some embodiments, the at least one coding region of the artificial nucleic acid comprises at least one modified nucleic acid sequence as described herein. Therein, the at least one coding region of the artificial nucleic acid preferably comprises or consists of a nucleic acid sequence according to any one of SEQ ID NO: 89-374, 633-954, 1268-1411, 1424-1567, 1576-1719, 1728-1871, 1880-2023, 2032-2175, 2184-2327, 2336-2479, 7908-26345, 26348-26355, 1260-1267, 1416-1423, 1568-1575, 1720-1727, 1872-1879, 2024-2031, 2176-2183, 2328-2335, or a fragment or variant of any one of these nucleic acid sequences.

More preferably, the at least one coding region of the artificial nucleic acid comprises or consists of at least one nucleic acid sequence according to any one of SEQ ID NO: 375-540, 2480-2639, 26356-26357, or a fragment or variant of any one of these nucleic acid sequences.

Flavivirus Envelope Protein

According to certain embodiments of the present invention, the artificial nucleic acid comprises or consists of at least one coding region encoding at least one polypeptide, which comprises or consists of a flavivirus envelope protein ("E" or "E protein"), or a fragment or variant thereof.

In flavivirus, the envelope protein is the major protein on the surface of the virion and typically represents the main target of neutralizing antibodies during natural infection. The E protein is structurally conserved amongst different flaviviruses and consists of three distinct domains. E domain III which is thought to interact with cellular receptors on target cells is an immunoglobulin-like domain forming small protrusions on the surface of an otherwise smooth spherical mature virus particle. Domain II is involved in E protein dimerization and contains a highly conserved hydrophobic fusion loop, which typically comprises 13 aa residues, at its distal end. These two structures are linked through a third central domain I by short flexible loops. The E protein is anchored to the viral membrane through the stem anchor helical domain and two anti-parallel transmembrane domains.

As used herein, the term "envelope protein" (or "E", "E protein") may refer to any (poly)peptide or protein comprising or consisting of the entire (full-length) wild type envelope protein of a flavivirus, such as a YFV or a DENV, or a fragment or variant thereof. An "envelope protein" as used herein thus preferably comprises or consists of any one of the aa sequences (and the respective encoding nucleic acid sequences) specified as such herein or in the sequence listing (e.g. by referring to "envelope protein", "E protein" or "E", standing alone or in the context of one or more further proteins, such as "prME"), or a fragment or variant of any one of these sequences. In a preferred embodiment, the artificial nucleic acid encodes a polypeptide comprising or consisting of a flavivirus envelope protein, or a fragment or variant thereof, comprising an aa sequence that is modified with respect to the wild type aa sequence of a flavivirus envelope protein, or the fragment or variant thereof.

According to some embodiments, the artificial nucleic acid encodes at least one polypeptide comprising or consisting of a YFV envelope protein, or a fragment or variant thereof, preferably as described herein, wherein the at least one polypeptide preferably comprises or consists of one or more of the following elements, or a fragment or variant thereof (explanation of abbreviations provided above): X; SS; E; XX.

According to a preferred embodiment, the artificial nucleic acid encodes at least one polypeptide comprising or consisting of YFV envelope protein, preferably in that order from N- to C-terminus, X, SSc, E and XX, or a fragment or variant of any of these elements.

According to further preferred embodiments, the artificial nucleic acid encodes at least one polypeptide comprising or consisting of a DENV envelope protein, or a fragment or variant thereof, preferably as described herein, wherein the at least one polypeptide preferably comprises or consists of one or more of the following elements, or a fragment or variant thereof (explanation of abbreviations provided above): SSm; SStPA; EdelTM; TM; Edel101-107; EΔaa1-391/Edelstem_TM; NS3; Ferritin; IRES: internal ribosomal entry site (IRES) from Encephalomyocarditis virus (EMCV); Linker: peptide linker SGG or G4SG4; WHbcAg.

In a preferred embodiment, the artificial nucleic acid comprises or consists of a nucleic acid sequence encoding YFV Envelope protein comprising or consisting of at least one aa sequence according to any one of SEQ ID NO: 29, 49, 50, or a fragment or variant of any one of these aa sequences. Additional information regarding each of these aa sequences of suitable YFV Envelope proteins of the invention may also be derived from the sequence listing, in particular from the details provided therein under identifier <223>.

In a preferred embodiment, the artificial nucleic acid comprises or consists of a nucleic acid sequence encoding a DENV envelope protein comprising or consisting of at least one aa sequence according to any one of SEQ ID NO: 968, 975-978, 995, 1002-1005, 1009, 1023, 1030-1033, 1037, 1051, 1060-1065, 1071, 1105, 1106, 26346, or a fragment or variant of any one of these aa sequences. Additional information regarding each of these aa sequences of suitable DENV Envelope proteins of the invention may also be derived from the sequence listing, in particular from the details provided therein under identifier <223>.

Preferably, the artificial nucleic acid comprises or consists of a nucleic acid sequence encoding a YFV envelope protein according to any one of SEQ ID NO: 63, 83, 84, 95, 121, 122, 133, 153, 154, 165, 185, 186, 197, 217, 218, 229, 249, 250, 261, 281, 282, 293, 313, 314, 325, 345, 346, 361, 362, 373, 374, 379, 380, 387, 388, 397, 398, 405, 406, 413, 414, 421, 422, 429, 430, 437, 438, 445, 446, 452, 453, 457, 458, 463, 464, 471, 472, 479, 480, 487, 488, 495, 496, 503, 504, 511, 512, 519, 520, 527, 528, 534, 535, 539, 540, or a fragment or variant of any one of these nucleic acid sequences. Additional information regarding each of these nucleic acid sequences encoding suitable YFV Envelope proteins may also be derived from the sequence listing, in particular from the details provided therein under identifier <223>.

Preferably, the artificial nucleic acid comprises or consists of a nucleic acid sequence encoding a DENV envelope protein according to any one of 1121, 1128-1131, 1148, 1155-1158, 1162, 1176, 1183-1186, 1190, 1204, 1213-1218, 1224, 1258, 1259, 1273, 1280-1283, 1300, 1307-1310, 1314, 1328, 1335-1338, 1342, 1356, 1365-1370, 1376, 1410, 1411, 1429, 1436-1439, 1456, 1463-1466, 1470, 1484, 1491-1494, 1498, 1512, 1521-1526, 1532, 1566, 1567, 1581, 1588-1591, 1608, 1615-1618, 1622, 1636, 1643-1646, 1650, 1664, 1673-1678, 1684, 1718, 1719, 1733, 1740-1743, 1760, 1767-1770, 1774, 1788, 1795-1798, 1802, 1816, 1825-1830, 1836, 1870, 1871, 1885, 1892-1895, 1912, 1919-1922, 1926, 1940, 1947-1950, 1954, 1968, 1977-1982, 1988, 2022, 2023, 2037, 2044-2047, 2064, 2071-2074, 2078, 2092, 2099-2102, 2106, 2120, 2129-2134, 2140, 2174, 2175, 2189, 2196-2199, 2216, 2223-2226, 2230, 2244, 2251-2254, 2258, 2272, 2281-2286, 2292, 2326, 2327, 2341, 2348-2351, 2368, 2375-2378, 2382, 2396, 2403-2406, 2410, 2424, 2433-2438, 2444, 2478, 2479, 2494, 2506, 2520, 2554, 2555, 2558, 2559, 2574, 2586, 2600, 2634, 2635, 2638, 2639, 26347-26357, or a fragment or variant of any one of these nucleic acid sequences. Additional information regarding each of these nucleic acid sequences encoding suitable DENV Envelope proteins may also be derived from the sequence listing, in particular from the details provided therein under identifier <223>.

Preferably, the at least one coding region of the artificial nucleic acid comprises or consists of a nucleic acid sequence encoding a YFV envelope protein according to any one of SEQ ID NO: 63, 83, 84, 95, 121, 122, 133, 153, 154, 165, 185, 186, 197, 217, 218, 229, 249, 250, 261, 281, 282, 293, 313, 314, 325, 345, 346, 361, 362, 373, 374, or a fragment or variant of any one of these nucleic acid sequences. Additional information regarding each of these nucleic acid sequences encoding suitable YFV Envelope proteins may also be derived from the sequence listing, in particular from the details provided therein under identifier <223>.

Preferably, the at least one coding region of the artificial nucleic acid comprises or consists of a nucleic acid sequence encoding a DENV envelope protein according to any one of SEQ ID NO: 1121, 1128-1131, 1148, 1155-1158, 1162, 1176, 1183-1186, 1190, 1204, 1213-1218, 1224, 1258, 1259, 1273, 1280-1283, 1300, 1307-1310, 1314, 1328, 1335-1338, 1342, 1356, 1365-1370, 1376, 1410, 1411, 1429, 1436-1439, 1456, 1463-1466, 1470, 1484, 1491-1494, 1498, 1512, 1521-1526, 1532, 1566, 1567, 1581, 1588-1591, 1608, 1615-1618, 1622, 1636, 1643-1646, 1650, 1664, 1673-1678, 1684, 1718, 1719, 1733, 1740-1743, 1760, 1767-1770, 1774, 1788, 1795-1798, 1802, 1816, 1825-1830, 1836, 1870, 1871, 1885, 1892-1895, 1912, 1919-1922, 1926, 1940, 1947-1950, 1954, 1968, 1977-1982, 1988, 2022, 2023, 2037, 2044-2047, 2064, 2071-2074, 2078, 2092, 2099-2102, 2106, 2120, 2129-2134, 2140, 2174, 2175, 2189, 2196-2199, 2216, 2223-2226, 2230, 2244, 2251-2254, 2258, 2272, 2281-2286, 2292, 2326, 2327, 2341, 2348-2351, 2368, 2375-2378, 2382, 2396, 2403-2406, 2410, 2424, 2433-2438, 2444, 2478, 2479, 26347-26355, or a fragment or variant of any one of these nucleic acid sequences. Additional information regarding each of these nucleic acid sequences encoding suitable DENV Envelope proteins may also be derived from the sequence listing, in particular from the details provided therein under identifier <223>.

According to a preferred embodiment, the at least one coding region of the artificial nucleic acid comprises or consists of a nucleic acid sequence encoding a YFV envelope protein according to any one of SEQ ID NO: 95, 121, 122, 133, 153, 154, 165, 185, 186, 197, 217, 218, 229, 249, 250, 261, 281, 282, 293, 313, 314, 325, 345, 346, 361, 362, 373, 374, or a fragment or variant of any one of these nucleic acid sequences. Additional information regarding each of these nucleic acid sequences encoding suitable YFV Envelope proteins may also be derived from the sequence listing, in particular from the details provided therein under identifier <223>.

According to a preferred embodiment, the at least one coding region of the artificial nucleic acid comprises or consists of a nucleic acid sequence encoding a DENV envelope protein according to any one of SEQ ID NO: 1273, 1280-1283, 1300, 1307-1310, 1314, 1328, 1335-1338, 1342, 1356, 1365-1370, 1376, 1410, 1411, 1429, 1436-1439, 1456, 1463-1466, 1470, 1484, 1491-1494, 1498, 1512, 1521-1526, 1532, 1566, 1567, 1581, 1588-1591, 1608, 1615-1618, 1622, 1636, 1643-1646, 1650, 1664, 1673-1678, 1684, 1718, 1719, 1733, 1740-1743, 1760, 1767-1770, 1774, 1788, 1795-1798, 1802, 1816, 1825-1830, 1836, 1870, 1871, 1885, 1892-1895, 1912, 1919-1922, 1926, 1940, 1947-1950, 1954, 1968, 1977-1982, 1988, 2022, 2023, 2037, 2044-2047, 2064, 2071-2074, 2078, 2092, 2099-2102, 2106, 2120, 2129-2134, 2140, 2174, 2175, 2189, 2196-2199, 2216, 2223-2226, 2230, 2244, 2251-2254, 2258, 2272, 2281-2286, 2292, 2326, 2327, 2341, 2348-2351, 2368, 2375-2378, 2382, 2396, 2403-2406, 2410, 2424, 2433-2438, 2444, 2478, 2479, 26348-26355, or a fragment or variant of any one of these nucleic acid sequences. Additional information regarding each of these nucleic acid sequences encoding suitable DENV Envelope proteins may also be derived from the sequence listing, in particular from the details provided therein under identifier <223>.

Preferably, the at least one coding region of the artificial nucleic acid comprises or consists of a nucleic acid sequence encoding a YFV envelope protein according to any one of SEQ ID NO: 379, 380, 387, 388, 397, 398, 405, 406, 413, 414, 421, 422, 429, 430, 437, 438, 445, 446, 452, 453, 457, 458, 463, 464, 471, 472, 479, 480, 487, 488, 495, 496, 503, 504, 511, 512, 519, 520, 527, 528, 534, 535, 539, 540, or a fragment or variant of any one of these nucleic acid sequences. Additional information regarding each of these nucleic acid sequences encoding suitable YFV Envelope proteins may also be derived from the sequence listing, in particular from the details provided therein under identifier <223>.

Preferably, the at least one coding region of the artificial nucleic acid comprises or consists of a nucleic acid sequence encoding a DENV envelope protein according to any one of SEQ ID NO: 2494, 2506, 2520, 2554, 2555, 2558, 2559, 26356, 2574, 2586, 2600, 2634, 2635, 2638, 2639, 26357, or a fragment or variant of any one of these nucleic acid sequences. Additional information regarding each of these nucleic acid sequences encoding suitable DENV Envelope proteins may also be derived from the sequence listing, in particular from the details provided therein under identifier <223>.

TM-Domain Deletion Mutant Sequences of DENV:

According to a preferred embodiment, the artificial nucleic acid, preferably the at least one coding region of the artificial nucleic acid, encodes at least one polypeptide comprising a soluble variant of a flavivirus envelope protein, or a fragment or variant thereof. As used herein, a soluble variant of a flavivirus envelope protein (also referred to as "solE" or "soluble E (protein)") typically lacks a functional transmembrane domain ("delTM"), so that the soluble variant is preferably not inserted into the membrane.

According to some embodiments, the artificial nucleic acid encodes at least one polypeptide comprising or consisting of a soluble variant of DENV envelope protein, or a fragment or variant thereof, preferably as described herein, wherein the at least one polypeptide preferably comprises or consists of one or more of the following elements, or a fragment or variant thereof (explanation of abbreviations provided above): SSM; pr; pr(D104A); E; EdelTM; TM; Edelstem_TM; STEM_TM; Edel101-107; EΔaa1-391: DENV envelope protein E with indicated deletion (indicated aa region in respect of DENV-3 E protein); NS3; Ferritin; IRES; Linker: peptide linker SGG or G4SG4; WHbcAg.

Preferably, the artificial nucleic acid comprises or consists of a nucleic acid sequence encoding at least one polypeptide comprising or consisting of at least one aa sequence according to any one of SEQ ID NO: 976-978, 1003-1005, 1009, 1031-1033, 1037, 1061-1065, 1071, 1105, 1106, 26346, or a fragment or variant of any one of these aa sequences. Additional information regarding each of these soluble variant of DENV envelope protein may also be derived from the sequence listing, in particular from the details provided therein under identifier <223>.

More preferably, the artificial nucleic acid comprises or consists of a nucleic acid sequence according to any one of SEQ ID NO: 1129-1131, 1156-1158, 1162, 1184-1186, 1190, 1214-1218, 1224, 1258, 1259, 1281-1283, 1308-1310, 1314, 1336-1338, 1342, 1366-1370, 1376, 1410, 1411, 1437-1439, 1464-1466, 1470, 1492-1494, 1498, 1522-1526, 1532, 1566, 1567, 1589-1591, 1616-1618, 1622, 1644-1646, 1650, 1674-1678, 1684, 1718, 1719, 1741-1743, 1768-1770, 1774, 1796-1798, 1802, 1826-1830, 1836, 1870, 1871, 1893-1895, 1920-1922, 1926, 1948-1950, 1954, 1978-1982, 1988, 2022, 2023, 2045-2047, 2072-2074, 2078, 2100-2102, 2106, 2130-2134, 2140, 2174, 2175, 2197-2199, 2224-2226, 2230, 2252-2254, 2258, 2282-2286, 2292, 2326, 2327, 2349-2351, 2376-2378, 2382, 2404-2406, 2410, 2434-2438, 2444, 2478, 2479, 2494, 2506, 2520, 2554, 2555, 2558, 2559, 2574, 2586, 2600, 2634, 2635, 2638, 2639, 26347-26357, or a fragment or variant of any one of these nucleic acid sequences. Additional information regarding each of these nucleic acid sequences encoding suitable soluble variant of DENV envelope proteins may also be derived from the sequence listing, in particular from the details provided therein under identifier <223>.

In some embodiments, the at least one coding region of the artificial nucleic acid comprises or consists of a nucleic acid sequence according to any one of SEQ ID NO: 1129-1131, 1156-1158, 1162, 1184-1186, 1190, 1214-1218, 1224, 1258, 1259, 1281-1283, 1308-1310, 1314, 1336-1338, 1342, 1366-1370, 1376, 1410, 1411, 1437-1439, 1464-1466, 1470, 1492-1494, 1498, 1522-1526, 1532, 1566, 1567, 1589-1591, 1616-1618, 1622, 1644-1646, 1650, 1674-1678, 1684, 1718, 1719, 1741-1743, 1768-1770, 1774, 1796-1798, 1802, 1826-1830, 1836, 1870, 1871, 1893-1895, 1920-1922, 1926, 1948-1950, 1954, 1978-1982, 1988, 2022, 2023, 2045-2047, 2072-2074, 2078, 2100-2102, 2106, 2130-2134, 2140, 2174, 2175, 2197-2199, 2224-2226, 2230, 2252-2254, 2258, 2282-2286, 2292, 2326, 2327, 2349-2351, 2376-2378, 2382, 2404-2406, 2410, 2434-2438, 2444, 2478, 2479, 26347-26355, or a fragment or variant of any one of these nucleic acid sequences. Additional information regarding each of these nucleic acid sequences encoding suitable soluble variant of DENV envelope proteins may also be derived from the sequence listing, in particular from the details provided therein under identifier <223>.

According to certain embodiments, the at least one coding region of the artificial nucleic acid comprises or consists of a nucleic acid sequence according to any one of SEQ ID NO: 1281-1283, 1308-1310, 1314, 1336-1338, 1342, 1366-1370, 1376, 1410, 1411, 1437-1439, 1464-1466, 1470, 1492-1494, 1498, 1522-1526, 1532, 1566, 1567, 1589-1591, 1616-1618, 1622, 1644-1646, 1650, 1674-1678, 1684, 1718, 1719, 1741-1743, 1768-1770, 1774, 1796-1798, 1802, 1826-1830, 1836, 1870, 1871, 1893-1895, 1920-1922, 1926, 1948-1950, 1954, 1978-1982, 1988, 2022, 2023, 2045-2047, 2072-2074, 2078, 2100-2102, 2106, 2130-2134, 2140, 2174, 2175, 2197-2199, 2224-2226, 2230, 2252-2254, 2258, 2282-2286, 2292, 2326, 2327, 2349-2351, 2376-2378, 2382, 2404-2406, 2410, 2434-2438, 2444, 2478, 2479, 26348-26355, or a fragment or variant of any one of these nucleic acid sequences. Additional information regarding each of these nucleic acid sequences encoding suitable soluble variant of DENV envelope proteins may also be derived from the sequence listing, in particular from the details provided therein under identifier <223>.

In preferred embodiments, the at least one coding region of the artificial nucleic acid comprises or consists of a nucleic acid sequence according to any one of SEQ ID NO: 2494, 2506, 2520, 2554, 2555, 2558, 2559, 26356, 2574, 2586, 2600, 2634, 2635, 2638, 2639, 26357, or a fragment or variant of any one of these nucleic acid sequences. Additional information regarding each of these nucleic acid sequences encoding suitable soluble variant of DENV envelope proteins may also be derived from the sequence listing, in particular from the details provided therein under identifier <223>.

Pre-Fusion Confirmation Mutant Sequences of DENV:

In certain preferred embodiments, the artificial nucleic acid encodes at least one polypeptide comprising or consisting of a flavivirus envelope protein, or a fragment or variant thereof, comprising an aa sequence that stabilizes the monomeric or the dimeric conformation of the flavivirus envelope protein, or of the fragment or variant thereof. Preferably, said aa sequence stabilizes the pre-fusion conformation of the flavivirus envelope protein and/or inhibits formation of the post-fusion conformation of the flavivirus envelope protein. There are several ways for modifying the aa sequence of a flavivirus envelope protein so that it has the properties mentioned above. In a preferred embodiment, the artificial nucleic acid encodes at least one polypeptide comprising or consisting of a flavivirus envelope protein, or a fragment or variant thereof, wherein the aa sequence of the flavivirus envelope protein, or the fragment or variant thereof, may be modified by inserting, deleting or altering at least one aa residue in the fusion loop or in the hinge region of the flavivirus envelope protein as described herein, or the fragment or variant thereof. In addition or alternatively, the encoded polypeptide comprises a flavivirus protein, or a fragment or variant thereof, comprising additional cystein residues with respect to the corresponding wild type aa sequence, in order to allow for additional disulphide bonds between flavivirus envelope proteins or fragments or variants thereof, thus preferably stabilizing the dimeric conformation.

According to some embodiments, the artificial nucleic acid encodes at least one polypeptide comprising or consisting of a pre-fusion confirmation variant of DENV envelope protein, or a fragment or variant thereof, preferably as described herein, wherein the at least one polypeptide preferably comprises or consists of one or more of the following elements, or a fragment or variant thereof (explanation of abbreviations provided above): SSc; SSopt; pr; pr(D104A); M; prM; E; Edelstem_TM; STEM_TM; Edel101-107; E(H27N); E(G28C), (H242C); E(T76I); E(N89D); E(Y96H); E(R99P), (F108N); E(F108S); E(K110E); E(H149N); E(S184F); E(R186L); E(N240S); E(M258L); E(H259N); E(H259R); E(A265T); E(S296G); E(S311R); E(K321T); JEV.

According to some embodiments, the artificial nucleic acid comprises or consists of a nucleic acid sequence encoding at least one polypeptide comprising or consisting of at least one aa sequence according to any one of SEQ ID NO: 980, 983-989, 1007, 1011-1017, 1035, 1039-1045, 1067-1069, 1074-1096, 1098-1103, or a fragment or variant of any one of these aa sequences. Additional information regarding each of these aa sequences of suitable pre-fusion confirmation variant of DENV envelope protein may also be derived from the sequence listing, in particular from the details provided therein under identifier <223>.

Preferably, the artificial nucleic acid comprises or consists of a nucleic acid sequence according to any one of SEQ ID NO: 1133, 1136-1142, 1160, 1164-1170, 1188, 1192-1198, 1220-1222, 1227-1249, 1251-1256, 1285, 1288-1294, 1312, 1316-1322, 1340, 1344-1350, 1372-1374, 1379-1401, 1403-1408, 1441, 1444-1450, 1468, 1472-1478, 1496, 1500-1506, 1528-1530, 1535-1557, 1559-1564, 1593, 1596-1602, 1620, 1624-1630, 1648, 1652-1658, 1680-1682, 1687-1709, 1711-1716, 1745, 1748-1754, 1772, 1776-1782, 1800, 1804-1810, 1832-1834, 1839-1861, 1863-1868, 1897, 1900-1906, 1924, 1928-1934, 1952, 1956-1962, 1984-1986, 1991-2013, 2015-2020, 2049, 2052-2058, 2076, 2080-2086, 2104, 2108-2114, 2136-2138, 2143-2165, 2167-2172, 2201, 2204-2210, 2228, 2232-2238, 2256, 2260-2266, 2288-2290, 2295-2317, 2319-2324, 2353, 2356-2362, 2380, 2384-2390, 2408, 2412-2418, 2440-2442, 2447-2469, 2471-2476, 2481, 2484-2490, 2492, 2496-2502, 2504, 2508-2514, 2516-2518, 2523-2545, 2547-2552, 2561, 2564-2570, 2572, 2576-2582, 2584, 2588-2594, 2596-2598, 2603-2625, 2627-2632, or a fragment or variant of any one of these nucleic acid sequences. Additional information regarding each of these nucleic acid sequences encoding suitable pre-fusion confirmation variants of DENV envelope protein may also be derived from the sequence listing, in particular from the details provided therein under identifier <223>.

More preferably, the at least one coding region of the artificial nucleic acid comprises or consists of a nucleic acid sequence according to any one of SEQ ID NO: 1133, 1136-1142, 1160, 1164-1170, 1188, 1192-1198, 1220-1222, 1227-1249, 1251-1256, 1285, 1288-1294, 1312, 1316-1322, 1340, 1344-1350, 1372-1374, 1379-1401, 1403-1408, 1441, 1444-1450, 1468, 1472-1478, 1496, 1500-1506, 1528-1530, 1535-1557, 1559-1564, 1593, 1596-1602, 1620, 1624-1630, 1648, 1652-1658, 1680-1682, 1687-1709, 1711-1716, 1745, 1748-1754, 1772, 1776-1782, 1800, 1804-1810, 1832-1834, 1839-1861, 1863-1868, 1897, 1900-1906, 1924, 1928-1934, 1952, 1956-1962, 1984-1986, 1991-2013, 2015-2020, 2049, 2052-2058, 2076, 2080-2086, 2104, 2108-2114, 2136-2138, 2143-2165, 2167-2172, 2201, 2204-2210, 2228, 2232-2238, 2256, 2260-2266, 2288-2290, 2295-2317, 2319-2324, 2353, 2356-2362, 2380, 2384-2390, 2408, 2412-2418, 2440-2442, 2447-2469, 2471-2476, or a fragment or variant of any one of these nucleic acid sequences. Additional information regarding each of these nucleic acid sequences encoding suitable pre-fusion confirmation variants of DENV envelope protein may also be derived from the sequence listing, in particular from the details provided therein under identifier <223>.

Even more preferably, the at least one coding region of the artificial nucleic acid comprises or consists of a nucleic acid sequence according to any one of SEQ ID NO: 1285, 1288-1294, 1312, 1316-1322, 1340, 1344-1350, 1372-1374, 1379-1401, 1403-1408, 1441, 1444-1450, 1468, 1472-1478, 1496, 1500-1506, 1528-1530, 1535-1557, 1559-1564, 1593, 1596-1602, 1620, 1624-1630, 1648, 1652-1658, 1680-1682, 1687-1709, 1711-1716, 1745, 1748-1754, 1772, 1776-1782, 1800, 1804-1810, 1832-1834, 1839-1861, 1863-1868, 1897, 1900-1906, 1924, 1928-1934, 1952, 1956-1962, 1984-1986, 1991-2013, 2015-2020, 2049, 2052-2058, 2076, 2080-2086, 2104, 2108-2114, 2136-2138, 2143-2165, 2167-2172, 2201, 2204-2210, 2228, 2232-2238, 2256, 2260-2266, 2288-2290, 2295-2317, 2319-2324, 2353, 2356-2362, 2380, 2384-2390, 2408, 2412-2418, 2440-2442, 2447-2469, 2471-2476, or a fragment or variant of any one of these nucleic acid sequences. Additional information regarding each of these nucleic acid sequences encoding suitable pre-fusion confirmation variants of DENV envelope protein may also be derived from the sequence listing, in particular from the details provided therein under identifier <223>.

In further preferred embodiments, the at least one coding region of the artificial nucleic acid comprises or consists of a nucleic acid sequence according to any one of SEQ ID NO: 2481, 2484-2490, 2492, 2496-2502, 2504, 2508-2514, 2516-2518, 2523-2545, 2547-2552, 2561, 2564-2570, 2572, 2576-2582, 2584, 2588-2594, 2596-2598, 2603-2625, 2627-2632, or a fragment or variant of any one of these nucleic acid sequences. Additional information regarding each of these nucleic acid sequences encoding suitable pre-fusion confirmation variants of DENV envelope protein may also be derived from the sequence listing, in particular from the details provided therein under identifier <223>.

Flavivirus (Pre)Membrane Protein Sequences: In a preferred embodiment, the artificial nucleic acid comprises or consists of at least one coding region encoding at least one polypeptide, which comprises or consists of a flavivirus premembrane ("prM" and a flavivirus membrane ("M") protein, or a fragment or variant of any one of these proteins. The flavivirus (pre-) membrane protein ((pr)M) is a seven β-stranded glycoprotein that facilitates E protein folding and regulates the oligomeric state of E proteins to prevent adventitious fusion during the egress of virus particles from infected cells. The expression of the E protein together with prM or M allows for secretion of the E protein in the form of virus-like particles (VLP) and maintaining the integrity of neutralizing epitopes on E protein. The VLP are similar to infectious virus in terms of structure but are safer as they are noninfectious.

As used herein, the terms "premembrane protein" and "membrane protein" may refer to any (poly)peptide or protein comprising or consisting of the entire (full-length) wild type (pre-) membrane protein of a flavivirus, such as a YFV or a DENV, or a fragment or variant thereof.

According to a preferred embodiment, the artificial nucleic acid encodes at least one polypeptide comprising or consisting of a flavivirus prM protein, or a fragment or variant thereof, wherein the flavivirus prM protein, or the fragment or the variant thereof comprises a mutated furin cleavage site, preferably as described herein.

Flavivirus (Pr)ME Protein

According to a preferred embodiment of the present invention, the artificial nucleic acid comprises or consists of at least one coding region encoding at least one polypeptide, which comprises or consists of, preferably in this order from N-terminus to C-terminus, a flavivirus premembrane ("prM" or a flavivirus membrane ("M") protein, or a fragment or variant of any one of these proteins, and a flavivirus envelope protein ("E"), or a fragment or variant of that protein, wherein the flavivirus proteins are preferably as described herein.

In the context of the present invention, a polypeptide comprising or consisting of a flavivirus premembrane ("prM" or a flavivirus membrane ("M") protein, or a fragment or variant of any one of these proteins, and a flavivirus envelope protein ("E"), or a fragment or variant of that protein, is preferably referred to as "prME" or as "ME" protein, respectively.

In particular, the present invention provides an artificial nucleic acid comprising a) at least one coding region encoding at least one polypeptide comprising a flavivirus premembrane protein (prM) or a flavivirus membrane protein (M) or a fragment or variant of any one of these proteins, and a flavivirus envelope protein (E) or a fragment or variant thereof, and b) an untranslated region (UTR) comprising at least one heterologous UTR element, wherein the flavivirus premembrane protein (prM), the flavivirus membrane protein (M) and the flavivirus envelope protein (E) are derived from yellow fever virus or from dengue virus.

Preferably, the artificial nucleic acid comprises a) at least one coding region encoding at least one polypeptide, wherein the at least one encoded polypeptide comprises in this order from N-terminus to C-terminus a flavivirus premembrane protein (prM), or a flavivirus membrane protein (M) or a fragment or variant of any one of these proteins, and a flavivirus envelope protein (E) or a fragment or variant thereof, and b) an untranslated region (UTR) comprising at least one heterologous UTR element, wherein the flavivirus premembrane protein (prM), the flavivirus membrane protein (M) and the flavivirus envelope protein (E) are derived from yellow fever virus or from dengue virus.

More preferably, the artificial nucleic acid comprises a) at least one coding region encoding a flavivirus prME protein or a flavivirus ME protein, preferably as defined herein, or a fragment or variant thereof, and b) an untranslated region (UTR) comprising at least one heterologous UTR element, wherein the flavivirus prME protein or the flavivirus ME protein is derived from yellow fever virus or from dengue virus.

According to some embodiments, the artificial nucleic acid encodes at least one polypeptide comprising or consisting of a YFV M, prM, ME or prME protein, or a fragment or variant of any one of these proteins, preferably as described herein. In embodiments, the at least one polypeptide preferably comprises or consists of at least one of the following elements, or a fragment or variant thereof (explanation of abbreviations provided above): C; X; SS; pr; M; prM; E; prME; NS1; TMcFlag; intFlag.

The N-terminal overhang of the capsid protein (e.g. 92-MRGLSSRKRR-101; "N-terminal overhang" or "X") was included because it should be beneficial for the correct translocation and orientation of the prM/E membrane protein into the membrane of the endoplasmic reticulum. The "N-terminal overhang" sequence (MRGLSSRKRR) contains five positively charged residues (K, R) which may be important for the anchoring of the prM/E protein. 10 additional residues of the amino terminus of NS1 (e.g. 779-DQGCAINFGK-788; "C-terminal overhang" or "XX") were included to facilitate the correct incorporation into the ER membrane and efficient processing of the polyprotein prM/E by the host signal peptidase.

According to further preferred embodiments, the artificial nucleic acid encodes at least one polypeptide comprising or consisting of a DENV M, prM, ME or prME protein, or a fragment or variant of any one of these proteins, preferably as described herein. In embodiments, the at least one polypeptide preferably comprises or consists of at least one of the following elements, or a fragment or variant thereof (explanation of abbreviations provided above): C; SSc; SSopt; pr; pr(D104A); M; prM; prME; E; Edelstem_TM; STEM_TM; Edel101-107; E(H27N); E(G28C), (H242C); E(T76I); E(N89D); E(Y96H); E(R99P), (F108N); E(F108S); E(K110E); E(H149N); E(S184F); E(R186L); E(N240S); E(M258L); E(H259N); E(H259R); E(A265T); E(S296G); E(S311R); E(K321T); Edelstem_TM, del101-107, (R99P), (F108N); Edelstem_TM, (R186L), (A265T); Edelstem_TM, (H259N); Edelstem_TM, (F108S), (R186L), (A265T); Edelstem_TM, (F108S); EDEL101-107, (R99P), (F108N); E((F108S)),R186L, (A265T); E(R186L), (A265T); NS1; NS3; IRES; JEV; P2A.

Preferably, the artificial nucleic acid comprises or consists of a nucleic acid sequence encoding at least one polypeptide (YFV (pr)ME) comprising or consisting of at least one aa sequence according to any one of SEQ ID NO: 30, 31, 39, 40, 48, 51, 52, 53, 54, 541-586, or a fragment or variant of any one of these aa sequences. Additional information regarding each of these aa sequences of suitable YFV (pr)ME proteins may also be derived from the sequence listing, in particular from the details provided therein under identifier <223>.

Preferably, the artificial nucleic acid comprises or consists of a nucleic acid sequence encoding at least one polypeptide (DENV (pr)ME) comprising or consisting of at least one aa sequence according to any one of SEQ ID NO: 969-971, 979-989, 996-998, 1006-1008, 1010-1017, 1024-1026, 1034-1036, 1038-1045, 1052, 1053, 1056, 1066-1070, 1072-1104, 2640-5273, or a fragment or variant of any one of these aa sequences. Additional information regarding each of these aa sequences of suitable DENV (pr)ME proteins may also be derived from the sequence listing, in particular from the details provided therein under identifier <223>.

Preferably, the coding region of the artificial nucleic acid sequence according to the invention comprises a modified nucleic acid sequence, wherein the coding region preferably comprises a nucleic acid sequence according to any one of SEQ ID NO: 64, 65, 73, 74, 82, 85, 86, 96, 97, 105, 106, 120, 123, 124, 134, 135, 143, 144, 152, 155, 156, 166, 167, 175, 176, 184, 187, 188, 198, 199, 207, 208, 216, 219, 220, 230, 231, 239, 240, 248, 251, 252, 262, 263, 271, 272, 280, 283, 284, 294, 295, 303, 304, 312, 315, 316, 326, 327, 335, 336, 344, 347, 348, 351, 352, 360, 363, 364, 372, 587-954, 1122-1124, 1132-1142, 1149-1151, 1159-1161, 1163-1170, 1177-1179, 1187-1189, 1191-1198, 1205, 1206, 1209, 1219-1223, 1225-1257, 1274-1276, 1284-1294, 1301-1303, 1311-1313, 1315-1322, 1329-1331, 1339-1341, 1343-1350, 1357, 1358, 1361, 1371-1375, 1377-1409, 1430-1432, 1440-1450, 1457-1459, 1467-1469, 1471-1478, 1485-1487, 1495-1497, 1499-1506, 1513, 1514, 1517, 1527-1531, 1533-1565, 1582-1584, 1592-1602, 1609-1611, 1619-1621, 1623-1630, 1637-1639, 1647-1649, 1651-1658, 1665, 1666, 1669, 1679-1683, 1685-1717, 1734-1736, 1744-1754, 1761-1763, 1771-1773, 1775-1782, 1789-1791, 1799-1801, 1803-1810, 1817, 1818, 1821, 1831-1835, 1837-1869, 1886-1888, 1896-1906, 1913-1915, 1923-1925, 1927-1934, 1941-1943, 1951-1953, 1955-1962, 1969, 1970, 1973, 1983-1987, 1989-2021, 2038-2040, 2048-2058, 2065-2067, 2075-2077, 2079-2086, 2093-2095, 2103-2105, 2107-2114, 2121, 2122, 2125, 2135-2139, 2141-2173, 2190-2192, 2200-2210, 2217-2219, 2227-2229, 2231-2238, 2245-2247, 2255-2257, 2259-2266, 2273, 2274, 2277, 2287-2291, 2293-2325, 2342-2344, 2352-2362, 2369-2371, 2379-2381, 2383-2390, 2397-2399, 2407-2409, 2411-2418, 2425, 2426, 2429, 2439-2443, 2445-2477, 5274-26345, more preferably according to any one of SEQ ID NO: 96, 97, 105, 106, 120, 123, 124, 134, 135, 143, 144, 152, 155, 156, 166, 167, 175, 176, 184, 187, 188, 198, 199, 207, 208, 216, 219, 220, 230, 231, 239, 240, 248, 251, 252, 262, 263, 271, 272, 280, 283, 284, 294, 295, 303, 304, 312, 315, 316, 326, 327, 335, 336, 344, 347, 348, 351, 352, 360, 363, 364, 372, 633-954, 1274-1276, 1284-1294, 1301-1303, 1311-1313, 1315-1322, 1329-1331, 1339-1341, 1343-1350, 1357, 1358, 1361, 1371-1375, 1377-1409, 1430-1432, 1440-1450, 1457-1459, 1467-1469, 1471-1478, 1485-1487, 1495-1497, 1499-1506, 1513, 1514, 1517, 1527-1531, 1533-1565, 1582-1584, 1592-1602, 1609-1611, 1619-1621, 1623-1630, 1637-1639, 1647-1649, 1651-1658, 1665, 1666, 1669, 1679-1683, 1685-1717, 1734-1736, 1744-1754, 1761-1763, 1771-1773, 1775-1782, 1789-1791, 1799-1801, 1803-1810, 1817, 1818, 1821, 1831-1835, 1837-1869, 1886-1888, 1896-1906, 1913-1915, 1923-1925, 1927-1934, 1941-1943, 1951-1953, 1955-1962, 1969, 1970, 1973, 1983-1987, 1989-2021, 2038-2040, 2048-2058, 2065-2067, 2075-2077, 2079-2086, 2093-2095, 2103-2105, 2107-2114, 2121, 2122, 2125, 2135-2139, 2141-2173, 2190-2192, 2200-2210, 2217-2219, 2227-2229, 2231-2238, 2245-2247, 2255-2257, 2259-2266, 2273, 2274, 2277, 2287-2291, 2293-2325, 2342-2344, 2352-2362, 2369-2371, 2379-2381, 2383-2390, 2397-2399, 2407-2409, 2411-2418, 2425, 2426, 2429, 2439-2443, 2445-2477, 7908-26345 or a fragment or variant of any one of these nucleic acid sequences, even more preferably, wherein the artificial nucleic acid comprises a nucleic acid sequence according to any one of SEQ ID NO: 376-378, 381, 382, 384-386, 389-392, 394-396, 399, 400, 402-404, 407, 408, 410-412, 415, 416, 418-420, 423, 424, 426-428, 431, 432, 434-436, 439, 440, 442-444, 447-449, 450, 451, 454-456, 2480-2493, 2495-2505, 2507-2519, 2521-2553, 2556, 2557, 26356, or a nucleic acid sequence according to any one of SEQ ID NO: 460-462, 465, 466, 468-470, 473, 474, 476-478, 481, 482, 484-486, 489, 490, 492-494, 497, 498, 500-502, 505, 506, 508-510, 513, 514, 516-518, 521, 522, 524-526, 529-533, 536-538, 2560-2573, 2575-2585, 2587-2599, 2601-2633, 2636, 2637, 26357, or a fragment or variant of any one of these nucleic acid sequences.

More preferably, the artificial nucleic acid comprises or consists of a nucleic acid sequence encoding YFV (pr)ME according to any one of SEQ ID NO: 64, 65, 73, 74, 82, 85, 86, 96, 97, 105, 106, 120, 123, 124, 134, 135, 143, 144, 152, 155, 156, 166, 167, 175, 176, 184, 187, 188, 198, 199, 207, 208, 216, 219, 220, 230, 231, 239, 240, 248, 251, 252, 262, 263, 271, 272, 280, 283, 284, 294, 295, 303, 304, 312, 315, 316, 326, 327, 335, 336, 344, 347, 348, 351, 352, 360, 363, 364, 372, 587-954, 376-378, 381, 382, 384-, 389-392, 394-396, 399, 400, 402-404, 407, 408, 410-412, 415, 416, 418-420, 423, 424, 426-428, 431, 432, 434-436, 439, 440, 442-444, 447-451, 454-456, 460-462, 465, 466, 468-470, 473, 474, 476-478, 481, 482, 484-486, 489, 490, 492-494, 497, 498, 500-502, 505, 506, 508-510, 513, 514, 516-518, 521, 522, 524-526, 529-533, 536-538, or a fragment or variant of any one of these nucleic acid sequences. Additional information regarding each of these suitable nucleic acid sequences encoding YFV (pr)ME proteins may also be derived from the sequence listing, in particular from the details provided therein under identifier <223>.

More preferably, the artificial nucleic acid comprises or consists of a nucleic acid sequence encoding DENV (pr)ME according to any one of SEQ ID NO: 1122-1124, 1132-1142, 1149-1151, 1159-1161, 1163-1170, 1177-1179, 1187-1189, 1191-1198, 1205, 1206, 1209, 1219-1223, 1225-1257, 1274-1276, 1284-1294, 1301-1303, 1311-1313, 1315-1322, 1329-1331, 1339-1341, 1343-1350, 1357, 1358, 1361, 1371-1375, 1377-1409, 1430-1432, 1440-1450, 1457-1459, 1467-1469, 1471-1478, 1485-1487, 1495-1497, 1499-1506, 1513, 1514, 1517, 1527-1531, 1533-1565, 1582-1584, 1592-1602, 1609-1611, 1619-1621, 1623-1630, 1637-1639, 1647-1649, 1651-1658, 1665, 1666, 1669, 1679-1683, 1685-1717, 1734-1736, 1744-1754, 1761-1763, 1771-1773, 1775-1782, 1789-1791, 1799-1801, 1803-1810, 1817, 1818, 1821, 1831-1835, 1837-1869, 1886-1888, 1896-1906, 1913-1915, 1923-1925, 1927-1934, 1941-1943, 1951-1953, 1955-1962, 1969, 1970, 1973, 1983-1987, 1989-2021, 2038-2040, 2048-2058, 2065-2067, 2075-2077, 2079-2086, 2093-2095, 2103-2105, 2107-2114, 2121, 2122, 2125, 2135-2139, 2141-2173, 2190-2192, 2200-2210, 2217-2219, 2227-2229, 2231-2238, 2245-2247, 2255-2257, 2259-2266, 2273, 2274, 2277, 2287-2291, 2293-2325, 2342-2344, 2352-2362, 2369-2371, 2379-2381, 2383-2390, 2397-2399, 2407-2409, 2411-2418, 2425, 2426, 2429, 2439-2443, 2445-2477, 5274-26345, 2480-2493, 2495-2505, 2507-2519, 2521-2553, 2556, 2557, 2560-2573, 2575-2585, 2587-2599, 2601-2633, 2636, 2637, or a fragment or variant of any one of these nucleic acid sequences. Additional information regarding each of these suitable nucleic acid sequences encoding DENV (pr)ME proteins may also be derived from the sequence listing, in particular from the details provided therein under identifier <223>.

Even more preferably, the at least one coding region of the artificial nucleic acid comprises or consists of a nucleic acid sequence encoding YFV (pr)ME according to any one of SEQ ID NO: 64, 65, 73, 74, 82, 85, 86, 96, 97, 105, 106, 120, 123, 124, 134, 135, 143, 144, 152, 155, 156, 166, 167, 175, 176, 184, 187, 188, 198, 199, 207, 208, 216, 219, 220, 230, 231, 239, 240, 248, 251, 252, 262, 263, 271, 272, 280, 283, 284, 294, 295, 303, 304, 312, 315, 316, 326, 327, 335, 336, 344, 347, 348, 351, 352, 360, 363, 364, 372, 587-954, or a fragment or variant of any one of these nucleic acid sequences. Additional information regarding each of these suitable nucleic acid sequences encoding YFV (pr)ME proteins may also be derived from the sequence listing, in particular from the details provided therein under identifier <223>.

More preferably, the artificial nucleic acid comprises or consists of a nucleic acid sequence encoding DENV (pr)ME according to any one of SEQ ID NO: 1122-1124, 1132-1142, 1149-1151, 1159-1161, 1163-1170, 1177-1179, 1187-1189, 1191-1198, 1205, 1206, 1209, 1219-1223, 1225-1257, 1274-1276, 1284-1294, 1301-1303, 1311-1313, 1315-1322, 1329-1331, 1339-1341, 1343-1350, 1357, 1358, 1361, 1371-1375, 1377-1409, 1430-1432, 1440-1450, 1457-1459, 1467-1469, 1471-1478, 1485-1487, 1495-1497, 1499-1506, 1513, 1514, 1517, 1527-1531, 1533-1565, 1582-1584, 1592-1602, 1609-1611, 1619-1621, 1623-1630, 1637-1639, 1647-1649, 1651-1658, 1665, 1666, 1669, 1679-1683, 1685-1717, 1734-1736, 1744-1754, 1761-1763, 1771-1773, 1775-1782, 1789-1791, 1799-1801, 1803-1810, 1817, 1818, 1821, 1831-1835, 1837-1869, 1886-1888, 1896-1906, 1913-1915, 1923-1925, 1927-1934, 1941-1943, 1951-1953, 1955-1962, 1969, 1970, 1973, 1983-1987, 1989-2021, 2038-2040, 2048-2058, 2065-2067, 2075-2077, 2079-2086, 2093-2095, 2103-2105, 2107-2114, 2121, 2122, 2125, 2135-2139, 2141-2173, 2190-2192, 2200-2210, 2217-2219, 2227-2229, 2231-2238, 2245-2247, 2255-2257, 2259-2266, 2273, 2274, 2277, 2287-2291, 2293-2325, 2342-2344, 2352-2362, 2369-2371, 2379-2381, 2383-2390, 2397-2399, 2407-2409, 2411-2418, 2425, 2426, 2429, 2439-2443, 2445-2477, 5274-26345, or a fragment or variant of any one of these nucleic acid sequences. Additional information regarding each of these suitable nucleic acid sequences encoding DENV (pr)ME proteins may also be derived from the sequence listing, in particular from the details provided therein under identifier <223>.

Even more preferably, the at least one coding region of the artificial nucleic acid comprises or consists of a (modified) nucleic acid sequence encoding YFV (pr)ME according to any one of SEQ ID NO: 96, 97, 105, 106, 120, 123, 124, 134, 135, 143, 144, 152, 155, 156, 166, 167, 175, 176, 184, 187, 188, 198, 199, 207, 208, 216, 219, 220, 230, 231, 239, 240, 248, 251, 252, 262, 263, 271, 272, 280, 283, 284, 294, 295, 303, 304, 312, 315, 316, 326, 327, 335, 336, 344, 347, 348, 351, 352, 360, 363, 364, 372, 633-954, or a fragment or variant of any one of these nucleic acid sequences. Additional information regarding each of these suitable (modified) nucleic acid sequences encoding YFV (pr)ME proteins may also be derived from the sequence listing, in particular from the details provided therein under identifier <223>.

Even more preferably, the at least one coding region of the artificial nucleic acid comprises or consists of a (modified) nucleic acid sequence encoding DENV (pr)ME according to any one of SEQ ID NO: 1274-1276, 1284-1294, 1301-1303, 1311-1313, 1315-1322, 1329-1331, 1339-1341, 1343-1350, 1357, 1358, 1361, 1371-1375, 1377-1409, 1430-1432, 1440-1450, 1457-1459, 1467-1469, 1471-1478, 1485-1487, 1495-1497, 1499-1506, 1513, 1514, 1517, 1527-1531, 1533-1565, 1582-1584, 1592-1602, 1609-1611, 1619-1621, 1623-1630, 1637-1639, 1647-1649, 1651-1658, 1665, 1666, 1669, 1679-1683, 1685-1717, 1734-1736, 1744-1754, 1761-1763, 1771-1773, 1775-1782, 1789-1791, 1799-1801, 1803-1810, 1817, 1818, 1821, 1831-1835, 1837-1869, 1886-1888, 1896-1906, 1913-1915, 1923-1925, 1927-1934, 1941-1943, 1951-1953, 1955-1962, 1969, 1970, 1973, 1983-1987, 1989-2021, 2038-2040, 2048-2058, 2065-2067, 2075-2077, 2079-2086, 2093-2095, 2103-2105, 2107-2114, 2121, 2122, 2125, 2135-2139, 2141-2173, 2190-2192, 2200-2210, 2217-2219, 2227-2229, 2231-2238, 2245-2247, 2255-2257, 2259-2266, 2273, 2274, 2277, 2287-2291, 2293-2325, 2342-2344, 2352-2362, 2369-2371, 2379-2381, 2383-2390, 2397-2399, 2407-2409, 2411-2418, 2425, 2426, 2429, 2439-2443, 2445-2477, 7908-26345, or a fragment or variant of any one of these nucleic acid sequences. Additional information regarding each of these suitable (modified) nucleic acid sequences encoding DENV (pr)ME proteins may also be derived from the sequence listing, in particular from the details provided therein under identifier <223>.

In preferred embodiments, the at least one coding region of the artificial nucleic acid, preferably an mRNA encoding YFV (pr)ME, comprises or consists of a nucleic acid sequence according to any one of SEQ ID NO: 376-378, 381, 382, 384-386, 389-392, 394-396, 399, 400, 402-404, 407, 408, 410-412, 415, 416, 418-420, 423, 424, 426-428, 431, 432, 434-436, 439, 440, 442-444, 447-449, 450, 451, 454-456, or a fragment or variant of any one of these nucleic acid sequences. In further embodiments, the at least one coding region of the artificial nucleic acid, preferably an mRNA encoding YFV (pr)ME, comprises or consists of a nucleic acid sequence according to any one of SEQ ID NO: 460-462, 465, 466, 468-470, 473, 474, 476-478, 481, 482, 484-486, 489, 490, 492-494, 497, 498, 500-502, 505, 506, 508-510, 513, 514, 516-518, 521, 522, 524-526, 529-533, 536-538, or a fragment or variant of any one of these nucleic acid sequences. Additional information regarding each of these suitable nucleic acid sequences (mRNA) encoding YFV (pr)ME proteins may also be derived from the sequence listing, in particular from the details provided therein under identifier <223>.

In preferred embodiments, the at least one coding region of the artificial nucleic acid, preferably an mRNA encoding DENV (pr)ME, comprises or consists of a nucleic acid sequence according to any one of SEQ ID NO: 2480-2493, 2495-2505, 2507-2519, 2521-2553, 2556, 2557, or a fragment or variant of any one of these nucleic acid sequences. In further embodiments, the at least one coding region of the artificial nucleic acid, preferably an mRNA encoding DENV (pr)ME, comprises or consists of a nucleic acid sequence according to any one of SEQ ID NO: 2560-2573, 2575-2585, 2587-2599, 2601-2633, 2636, 2637, or a fragment or variant of any one of these nucleic acid sequences. Additional information regarding each of these suitable nucleic acid sequences (mRNA) encoding DENV (pr)ME proteins may also be derived from the sequence listing, in particular from the details provided therein under identifier <223>.

Flavivirus Capsid Protein

In some embodiments, the artificial nucleic acid comprises or consists of at least one coding region encoding at least one polypeptide, which comprises or consists of a flavivirus capsid protein ("C" or "C protein"), or a fragment or variant thereof. In this context, the term "flavivirus capsid protein" may refer to any (poly)peptide or protein comprising or consisting of the entire (full-length) wild type capsid protein of a flavivirus, such as a YFV or a DENV, or a fragment or variant thereof.

Flavivirus Non-Structural Proteins

Furthermore, the artificial nucleic acid may comprise or consist of at least one coding region encoding at least one polypeptide, which comprises or consists of a flavivirus non-structural protein ("NS" or "NS protein"; e.g. NS1, NS2A, NS2B, NS4 etc.), or a fragment or variant thereof. In this context, the term "flavivirus non-structural protein" may refer to any (poly)peptide or protein comprising or consisting of an entire (full-length) wild type non-structural protein of a flavivirus, such as a YFV or a DENV, or a fragment or variant thereof. NS1 protein, which can be present in ER-bound, membrane-bound or secreted form, depending on the glycosylation status, can contribute towards the enhancement of antibody-dependent complement-mediated lysis and increase the activity of cytotoxic T cells. Although the E protein is the main immunogen for the induction of neutralising antibodies, other structural (capsid) and non-structural antigens (NS1 and NS3) of DENV can contribute towards vaccine-induced immune response and potentially crucially improve the quality of the B- and T-cell immune responses. NS3 protein is conserved among the various Dengue serotypes and is regarded as the main target of cellular CD4+ and CD8+ T-cell immune responses.

Further Modifications of a Flavivirus Protein

In the following, some preferred embodiments are described by way of example, wherein the artificial nucleic acid encodes at least one polypeptide comprising or consisting of a modified or mutated flavivirus protein, such as the flavivirus proteins described herein.

According to some embodiments, the artificial nucleic acid encodes at least one polypeptide comprising or consisting of at least one flavivirus protein or a fragment or variant thereof, preferably as described herein, more preferably a YFV protein or a DENV protein, or a fragment or variant of any one of these proteins, wherein the at least one polypeptide preferably comprises or consists of at least one of the following elements, or a fragment or variant thereof (explanation of abbreviations provided above): SStPA; Ferritin; WHbcAg; JEV; SSopt; Linker SGG or G4SG4; P2A/F2A; IRES.

In preferred embodiments, the artificial nucleic acid encodes at least one polypeptide comprising or consisting of a flavivirus envelope protein or a flavivirus (pr)ME protein as described herein, wherein the polypeptide further comprises at least one element selected from the group consisting of SStPA; Ferritin; WHbcAg; JEV; SSopt; Linker(SGG); Linker(G4SG4); P2A/F2A and IRES, or a fragment or variant of any one of these elements.

Preferably, the artificial nucleic acid comprises or consists of a nucleic acid sequence encoding at least one polypeptide comprising or consisting of at least one aa sequence according to any one of SEQ ID NO: 41-47, 55, 56, 972-974, 999-1001, 1027-1029, 1057-1059, 955-962, or a fragment or variant of any one of these aa sequences. In a preferred embodiment, the flavivirus protein, preferably a flavivirus envelope protein or the flavivirus (pr)ME protein, or the fragment or variant thereof, which is comprised in the polypeptide encoded by the artificial nucleic acid, comprises or consists of at least one aa sequence according to any one of SEQ ID NO: 41-47, 55, 56, 972-974, 999-1001, 1027-1029, 1057-1059, 955-962, or a fragment or variant of any one of these aa sequences. Additional information regarding each of these suitable aa sequences may also be derived from the sequence listing, in particular from the details provided therein under identifier <223>.

More preferably, the at least one coding region of the artificial nucleic acid comprises or consists of a nucleic acid sequence according to any one of SEQ ID NO: 75-81, 87, 88, 107-119, 125, 126, 145-151, 157, 158, 177-183, 189, 190, 209-215, 221, 222, 241-247, 253, 254, 273-279, 285, 286, 305-311, 317, 318, 337-343, 349, 350, 353-359, 365-371, 1125-1127, 1152-1154, 1180-1182, 1210-1212, 1277-1279, 1304-1306, 1332-1334, 1362-1364, 1433-1435, 1460-1462, 1488-1490, 1518-1520, 1585-1587, 1612-1614, 1640-1642, 1670-1672, 1737-1739, 1764-1766, 1792-1794, 1822-1824, 1889-1891, 1916-1918, 1944-1946, 1974-1976, 2041-2043, 2068-2070, 2096-2098, 2126-2128, 2193-2195, 2220-2222, 2248-2250, 2278-2280, 2345-2347, 2372-2374, 2400-2402, 2430-2432, 1107-1115, 1260-1267, 1416-1423, 1568-1575, 1720-1727, 1872-1879, 2024-2031, 2176-2183, 2328-2335, or a fragment or variant of any one of these nucleic acid sequences. Additional information regarding each of these suitable nucleic acid sequences may also be derived from the sequence listing, in particular from the details provided therein under identifier <223>.

In some embodiments, the at least one coding region of the artificial nucleic acid comprises or consists of a nucleic acid sequence according to any one of SEQ ID NO: 107-119, 125, 126, 145-151, 157, 158, 177-183, 189, 190, 209-215, 221, 222, 241-247, 253, 254, 273-279, 285, 286, 305-311, 317, 318, 337-343, 349, 350, 353-359, 365-371, 1277-1279, 1304-1306, 1332-1334, 1362-1364, 1433-1435, 1460-1462, 1488-1490, 1518-1520, 1585-1587, 1612-1614, 1640-1642, 1670-1672, 1737-1739, 1764-1766, 1792-1794, 1822-1824, 1889-1891, 1916-1918, 1944-1946, 1974-1976, 2041-2043, 2068-2070, 2096-2098, 2126-2128, 2193-2195, 2220-2222, 2248-2250, 2278-2280, 2345-2347, 2372-2374, 2400-2402, 2430-2432, 1260-1267, 1416-1423, 1568-1575, 1720-1727, 1872-1879, 2024-2031, 2176-2183, 2328-2335, or a fragment or variant of any one of these nucleic acid sequences. Additional information regarding each of these suitable nucleic acid sequences may also be derived from the sequence listing, in particular from the details provided therein under identifier <223>.

The aa sequences (or the nucleic acid sequences, respectively) described herein as further modifications of a flavivirus protein are optionally added to the at least one encoded polypeptide comprising a flavivirus protein (or the artificial nucleic acid encoding it, respectively), or a fragment or variant thereof, in order to increase the expression of the encoded polypeptide, in particular when expressed in a mammalian cells, and in order to increase the immune response against said flavivirus protein or a fragment or variant thereof. In the following, some exemplary sequences are described that may be used for increasing the expression of the polypeptide, in particular in a mammalian cell, and the respective immune response against the flavivirus or a fragment or variant thereof.

According to a preferred embodiment, the artificial nucleic acid encodes at least one polypeptide comprising or consisting of at least one flavivirus protein, or a fragment or variant thereof, and further comprising at least one signal sequence or an aa sequence derived from a signal sequence, or a fragment or variant thereof. In the context of the present invention, a "signal sequence" is typically understood as an aa sequence that targets a peptide or protein to a cellular compartment, preferably a membrane, more preferably the membrane of the endoplasmic reticulum (ER membrane), and/or which promotes the export or the secretion of the peptide or protein from the cell. In particular, a "signal sequence" as understood in the context of the present invention may be any aa sequence (or corresponding coding nucleic acid sequence) that targets the polypeptide encoded by the artificial nucleic acid to the ER membrane or the endosomal-lysosomal compartment. A signal sequence may also be referred to as, for example, signal peptide, ER anchor, (ER) targeting peptide or (ER) targeting signal. As used herein, the term "signal sequence" may refer to an aa sequence or to the corresponding nucleic acid sequence encoding said aa sequence. Furthermore, the term "signal sequence" may also be used with respect to an aa sequence (or nucleic acid sequence) derived from a signal sequence, wherein the derived sequence preferably targets a peptide or protein to the ER membrane in comparable manner with respect to the signal sequence, it is derived from. Furthermore, the term "signal sequence" also comprises a fragment or variant, as described herein, of a signal sequence.

The signal sequence as used herein is not limited in any manner. In preferred embodiments, however, the encoded polypeptide comprises at least one signal sequence of a secretory protein or a signal sequence of a membrane protein, or a fragment or variant of any one of these signal sequences. Preferably, the signal sequence is derived from a flavivirus protein, such as a YFV protein or a DENV protein. A signal sequence as used herein preferably exhibits a length of about 10 to 30 aa and is preferably located at the N-terminus or at the C-terminus of the encoded polypeptide, without being limited thereto.

In preferred embodiments, the at least one signal sequence is heterologous with respect to the at least one flavivirus protein, or the fragment or variant thereof, comprised in the polypeptide encoded by the artificial nucleic acid. Preferably, the signal sequence is thus not derived from the flavivirus protein, or the fragment or variant thereof, comprised in the polypeptide.

According to a preferred embodiment, the artificial nucleic acid encodes at least one polypeptide comprising or consisting of at least one flavivirus protein, or a fragment or variant thereof, and further comprising at least one signal sequence selected from the group consisting of SS, SStPA, SSc, SSopt, SSm and JEV, or a fragment or variant of any one of these signal sequences, preferably as described herein.

In a further preferred embodiment, the artificial nucleic acid encodes at least one polypeptide comprising or consisting of at least one flavivirus protein, or a fragment or variant thereof, and further comprising at least one signal sequence, which is derived from Japanese Encephalitis virus (JEV), or a fragment or variant thereof. It is thus preferred that the at least one polypeptide encoded by the artificial nucleic acid comprises a signal sequence, wherein said signal sequence comprises or consists of an aa sequence according to SEQ ID NO: 958, or a fragment or variant thereof. Therein, the artificial nucleic acid preferably comprises a nucleic acid sequence according to any one of SEQ ID NO: 1110, 1263, 1419, 1571, 1723, 1875, 2027, 2179 or 2331, or a fragment or variant of any one of these nucleic acid sequences. Additional information regarding each of these sequences may also be derived from the sequence listing, in particular from the details provided therein under identifier <223>.

It may further be preferred that the at least one encoded polypeptide comprises at least one signal sequence derived from human tissue plasminogen activator (TPA), or a fragment or variant thereof. It is thus preferred that the polypeptide encoded by the artificial nucleic acid comprises a signal sequence, wherein said signal sequence comprises or consists of an aa sequence according to SEQ ID NO: 955, or a fragment or variant thereof. Therein, the artificial nucleic acid preferably comprises a nucleic acid sequence according to any one of SEQ ID NO: 1107, 1260, 1416, 1568, 1720, 1872, 2024, 2176 or 2328, or a fragment or variant of any one of these nucleic acid sequences. Additional information regarding each of these sequences may also be derived from the sequence listing, in particular from the details provided therein under identifier <223>.

Further examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulines as defined herein, signal sequences of the invariant chain of immunoglobulines or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartment. More preferably, signal sequences of MHC class I molecule HLA-A*0201 may be used according to the present invention.

In some embodiments, the artificial nucleic acid encodes at least one polypeptide comprising or consisting of at least one flavivirus protein, or a fragment or variant thereof, and further comprising at least one aa sequence, which promotes virus-like particle (VLP) formation, in particular when expressed in a mammalian cell.

In a preferred embodiment, the aa sequence promoting virus-like particle (VLP) formation is derived from Hepatitis B virus core antigen. For example, an aa sequence derived from Woodchuck hepatitis B virus core antigen (WHbcAg) may be used. It is thus preferred that the at least one polypeptide encoded by the artificial nucleic acid comprises an aa sequence promoting virus-like particle (VLP) formation, wherein said aa sequence comprises or consists of an aa sequence according to SEQ ID NO: 957, or a fragment or variant thereof. Therein, the artificial nucleic acid preferably comprises a nucleic acid sequence according to any one of SEQ ID NO: 1109, 1262, 1418, 1570, 1722, 1874, 2026, 2178 or 2330, or a fragment or variant of any one of these nucleic acid sequences. Additional information regarding each of these sequences may also be derived from the sequence listing, in particular from the details provided therein under identifier <223>.

According to a further preferred embodiment, the artificial nucleic acid encodes at least one polypeptide comprising the stem region of a flavivirus protein, preferably the stem region of a Japanese Encephalitis virus (JEV), or a fragment or variant thereof. Preferably, the at least one polypeptide encoded by the artificial nucleic acid comprises an aa sequence comprising or consisting of an aa sequence according to SEQ ID NO: 958, or a fragment or variant thereof. Therein, the artificial nucleic acid preferably comprises a nucleic acid sequence according to any one of SEQ ID NO: 1110, 1263, 1419, 1571, 1723, 1875, 2027, 2179 or 2331, or a fragment or variant of any one of these nucleic acid sequences. Additional information regarding each of these sequences may also be derived from the sequence listing, in particular from the details provided therein under identifier <223>.

According to some embodiments, the artificial nucleic acid encodes at least one polypeptide comprising or consisting of at least one flavivirus protein or a fragment or variant thereof, preferably as described herein, more preferably a DENV protein, or a fragment or variant thereof, wherein the at least one polypeptide preferably comprises or consists of at least one of the following elements, or a fragment or variant thereof (explanation of abbreviations provided above): SSc; SSopt; pr; pr(D104A); M; prM; Edelstem_TM; STEM_TM; Edel101-107; E(R99P), (F108N); E(F108S); E(R186L); E(H259N); E(A265T); E(K321T); JEV.

In preferred embodiments, the artificial nucleic acid encodes at least one polypeptide comprising or consisting of a DENV envelope protein or a DENV prME protein as described herein, wherein the polypeptide further comprises at least one element selected from the group consisting of SSc, prMEdelstem_TM and JEV, or a fragment or variant of any one of these elements. According to a particularly preferred embodiment, the artificial nucleic acid comprises at least one coding region, preferably as described herein, encoding at least one polypeptide comprising or consisting of SSc, prMEdelstem_TM and JEV, or a fragment or variant of any one of these elements, preferably in that order from N- to C-terminus.

Preferably, the artificial nucleic acid comprises or consists of a nucleic acid sequence encoding at least one polypeptide comprising or consisting of at least one aa sequence according to any one of SEQ ID NO: 981, 987-989, 1008, 1015-1017, 1036, 1043-1045, 1070, 1097-1103, or a fragment or variant of any one of these aa sequences.

More preferably, the artificial nucleic acid comprises or consists of a nucleic acid sequence according to any one of SEQ ID NO: 1134, 1140-1142, 1161, 1168-1170, 1189, 1196-1198, 1223, 1250-1256, 1286, 1292-1294, 1313, 1320-1322, 1341, 1348-1350, 1375, 1402-1408, 1442, 1448-1450, 1469, 1476-1478, 1497, 1504-1506, 1531, 1558-1564, 1594, 1600-1602, 1621, 1628-1630, 1649, 1656-1658, 1683, 1710-1716, 1746, 1752-1754, 1773, 1780-1782, 1801, 1808-1810, 1835, 1862-1868, 1898, 1904-1906, 1925, 1932-1934, 1953, 1960-1962, 1987, 2014-2020, 2050, 2056-2058, 2077, 2084-2086, 2105, 2112-2114, 2139, 2166-2172, 2202, 2208-2210, 2229, 2236-2238, 2257, 2264-2266, 2291, 2318-2324, 2354, 2360-2362, 2381, 2388-2390, 2409, 2416-2418, 2443, 2470-2476, 2482, 2488-2490, 2493, 2500-2502, 2505, 2512-2514, 2519, 2546-2552, 2562, 2568-2570, 2573, 2580-2582, 2585, 2592-2594, 2599, 2626-2632, or a fragment or variant of any one of these nucleic acid sequences. Additional information regarding each of these sequences may also be derived from the sequence listing, in particular from the details provided therein under identifier <223>.

More preferably, the at least one coding region of the artificial nucleic acid comprises or consists of a nucleic acid sequence according to any one of SEQ ID NO: 1134, 1140-1142, 1161, 1168-1170, 1189, 1196-1198, 1223, 1250-1256, 1286, 1292-1294, 1313, 1320-1322, 1341, 1348-1350, 1375, 1402-1408, 1442, 1448-1450, 1469, 1476-1478, 1497, 1504-1506, 1531, 1558-1564, 1594, 1600-1602, 1621, 1628-1630, 1649, 1656-1658, 1683, 1710-1716, 1746, 1752-1754, 1773, 1780-1782, 1801, 1808-1810, 1835, 1862-1868, 1898, 1904-1906, 1925, 1932-1934, 1953, 1960-1962, 1987, 2014-2020, 2050, 2056-2058, 2077, 2084-2086, 2105, 2112-2114, 2139, 2166-2172, 2202, 2208-2210, 2229, 2236-2238, 2257, 2264-2266, 2291, 2318-2324, 2354, 2360-2362, 2381, 2388-2390, 2409, 2416-2418, 2443, 2470-2476, or a fragment or variant of any one of these nucleic acid sequences. Additional information regarding each of these sequences may also be derived from the sequence listing, in particular from the details provided therein under identifier <223>.

More preferably, the at least one coding region of the artificial nucleic acid comprises or consists of a nucleic acid sequence according to any one of SEQ ID NO: 1286, 1292-1294, 1313, 1320-1322, 1341, 1348-1350, 1375, 1402-1408, 1442, 1448-1450, 1469, 1476-1478, 1497, 1504-1506, 1531, 1558-1564, 1594, 1600-1602, 1621, 1628-1630, 1649, 1656-1658, 1683, 1710-1716, 1746, 1752-1754, 1773, 1780-1782, 1801, 1808-1810, 1835, 1862-1868, 1898, 1904-1906, 1925, 1932-1934, 1953, 1960-1962, 1987, 2014-2020, 2050, 2056-2058, 2077, 2084-2086, 2105, 2112-2114, 2139, 2166-2172, 2202, 2208-2210, 2229, 2236-2238, 2257, 2264-2266, 2291, 2318-2324, 2354, 2360-2362, 2381, 2388-2390, 2409, 2416-2418, 2443, 2470-2476, or a fragment or variant of any one of these nucleic acid sequences. Additional information regarding each of these sequences may also be derived from the sequence listing, in particular from the details provided therein under identifier <223>.

Even more preferably, the at least one coding region of the artificial nucleic acid comprises or consists of a nucleic acid sequence according to any one of SEQ ID NO: 2482, 2488-2490, 2493, 2500-2502, 2505, 2512-2514, 2519, 2546-2552, 2562, 2568-2570, 2573, 2580-2582, 2585, 2592-2594, 2599, 2626-2632, or a fragment or variant of any one of these nucleic acid sequences. Additional information regarding each of these sequences may also be derived from the sequence listing, in particular from the details provided therein under identifier <223>.

In some embodiments, the artificial nucleic acid encodes at least one polypeptide comprising or consisting of at least one flavivirus protein, or a fragment or variant thereof, and further comprising at least one aa sequence, which promotes antigen clustering and/or formation of nanoparticles, in particular when expressed in a mammalian cell.

According to a further preferred embodiment, the artificial nucleic acid encodes at least one polypeptide comprising ferritin, an aa sequence derived from ferritin, or a fragment or variant thereof. In the context of the present invention, an aa sequence is preferably used, which is derived from ferritin of *Helicobacter pylori* as described by GenBank Accession Number NP_223316. Preferably, the at least one polypeptide encoded by the artificial nucleic acid comprises an aa sequence comprising or consisting of an aa sequence according to SEQ ID NO: 956, or a fragment or variant thereof. Therein, the artificial nucleic acid preferably comprises a nucleic acid sequence according to any one of SEQ ID NO: 1108, 1261, 1417, 1569, 1721, 1873, 2025, 2177 or 2329, or a fragment or variant of any one of these nucleic acid sequences. Additional information regarding each of these sequences may also be derived from the sequence listing, in particular from the details provided therein under identifier <223>.

In certain embodiments, the artificial nucleic acid encodes at least one polypeptide comprising or consisting of at least one flavivirus protein, or a fragment or variant thereof, wherein the flavivirus protein, or the fragment or variant thereof, comprises at least one aa sequence, which promotes self-cleavage of the polypeptide, in particular when expressed in a mammalian cell.

According to a further preferred embodiment, the artificial nucleic acid encodes at least one polypeptide comprising or consisting of at least one flavivirus protein, or a fragment or variant thereof, and further comprising the 2A peptide from foot-and-mouth disease virus or an aa sequence derived from the 2A peptide from foot-and-mouth disease virus, or a fragment or variant thereof. Preferably, the at least one polypeptide encoded by the artificial nucleic acid comprises an aa sequence comprising or consisting of an aa sequence according to SEQ ID NO: 962, or a fragment or variant thereof. Therein, the artificial nucleic acid preferably comprises a nucleic acid sequence according to any one of SEQ ID NO: 1114, 1267, 1423, 1575, 1727, 1879, 2031, 2183 or 2335, or a fragment or variant of any one of these nucleic acid sequences. Additional information regarding each of these sequences may also be derived from the sequence listing, in particular from the details provided therein under identifier <223>.

In some embodiments, the artificial nucleic acid encodes at least one polypeptide comprising at least one flavivirus protein, or a fragment or variant thereof, wherein the flavivirus protein, or a fragment or variant thereof, comprises a modified aa sequence with respect to the wild type flavivirus protein it is derived from. Said modified aa sequence is preferably an aa sequence, which is not present in the wild type aa sequence (e.g. an insertion of a (heterologous) aa sequence), or a mutated aa sequence (e.g. an aa sequence comprising one or more point mutations, insertions or deletions).

According to a preferred embodiment, the artificial nucleic acid encodes at least one polypeptide comprising or consisting of at least one flavivirus protein, or a fragment or variant thereof, comprising at least one mutated furin cleavage site. In this context, it is preferred that at least one furin cleavage site in the flavivirus protein is mutated, which preferably results in enhanced cleavage by a protease, more preferably by a furin protease. In some embodiments, a point mutation is introduced into at least one furin cleavage site in the flavivirus protein. In a preferred embodiment, the flaviprotein comprises or consists of a flavivirus prM protein as described herein, which comprises a mutated furin cleavage site that promotes cleavage between pr and M. In a particularly preferred embodiment, the prM protein is derived from DENV 3 (DENV-3), which comprises a point mutation at aa position 104, preferably a D104A mutation.

Preferably, the artificial nucleic acid comprises or consists of a nucleic acid sequence encoding at least one polypeptide comprising or consisting of at least one aa sequence according to any one of SEQ ID NO: 987, 1015, 1043, 1093-1095, 1098-1100, or a fragment or variant of any one of these aa sequences.

More preferably, the artificial nucleic acid comprises or consists of a nucleic acid sequence according to any one of SEQ ID NO: 1140, 1168, 1196, 1246-1248, 1251-1253, 1292, 1320, 1348, 1398-1400, 1403-1405, 1448, 1476, 1504, 1554-1556, 1559-1561, 1600, 1628, 1656, 1706-1708, 1711-1713, 1752, 1780, 1808, 1858-1860, 1863-1865, 1904, 1932, 1960, 2010-2012, 2015-2017, 2056, 2084, 2112, 2162-2164, 2167-2169, 2208, 2236, 2264, 2314-2316, 2319-2321, 2360, 2388, 2416, 2466-2468, 2471-2473, 2488, 2500, 2512, 2542-2544, 2547-2549, 2568, 2580, 2592, 2622-2624, 2627-2629, or a fragment or variant of any one of these nucleic acid sequences. Additional information regarding each of these sequences may also be derived from the sequence listing, in particular from the details provided therein under identifier <223>.

Even more preferably, the at least one coding region of the artificial nucleic acid comprises or consists of a nucleic acid sequence according to any one of SEQ ID NO: 1140, 1168, 1196, 1246-1248, 1251-1253, 1292, 1320, 1348, 1398-1400, 1403-1405, 1448, 1476, 1504, 1554-1556, 1559-1561, 1600, 1628, 1656, 1706-1708, 1711-1713, 1752, 1780, 1808, 1858-1860, 1863-1865, 1904, 1932, 1960, 2010-2012, 2015-2017, 2056, 2084, 2112, 2162-2164, 2167-2169, 2208, 2236, 2264, 2314-2316, 2319-2321, 2360, 2388, 2416, 2466-2468, 2471-2473, or a fragment or variant of any one of these nucleic acid sequences. Additional information regarding each of these sequences may also be derived from the sequence listing, in particular from the details provided therein under identifier <223>.

In some embodiments, the at least one coding region of the artificial nucleic acid comprises or consists of a nucleic acid sequence according to any one of SEQ ID NO: 1292, 1320, 1348, 1398-1400, 1403-1405, 1448, 1476, 1504, 1554-1556, 1559-1561, 1600, 1628, 1656, 1706-1708, 1711-1713, 1752, 1780, 1808, 1858-1860, 1863-1865, 1904, 1932, 1960, 2010-2012, 2015-2017, 2056, 2084, 2112, 2162-2164, 2167-2169, 2208, 2236, 2264, 2314-2316, 2319-2321, 2360, 2388, 2416, 2466-2468, 2471-2473, or a fragment or variant of any one of these nucleic acid sequences. Additional information regarding each of these sequences may also be derived from the sequence listing, in particular from the details provided therein under identifier <223>.

Preferably, the at least one coding region of the artificial nucleic acid comprises or consists of a nucleic acid sequence according to any one of SEQ ID NO: 2488, 2500, 2512, 2542-2544, 2547-2549, 2568, 2580, 2592, 2622-2624, 2627-2629, or a fragment or variant of any one of these nucleic acid sequences. Additional information regarding each of these sequences may also be derived from the sequence listing, in particular from the details provided therein under identifier <223>.

According to some embodiments, the artificial nucleic acid encodes at least one polypeptide comprising or consisting of at least one flavivirus protein, or a fragment or variant thereof, and further comprising at least one peptide linker. The peptide linker is not limited to any specific structure. Preferably, the peptide linker comprises from 1 to 50, more preferably from 1 to 25, even more preferably from 1 to 15, most preferably from 1 to 10 aa residues. In some embodiments, the peptide linker may comprise at least 1, preferably at least 2, more preferably at least 3, even more preferably at least 4, most preferably at least 5, aa residues. Preferably, the at least one polypeptide encoded by the artificial nucleic acid comprises an aa sequence comprising or consisting of an aa sequence according to SEQ ID NO: 959, 960 or 961, or a fragment or variant thereof. Therein, the artificial nucleic acid preferably comprises a nucleic acid sequence according to any one of SEQ ID NO: 1111, 1264, 1420, 1572, 1724, 1876, 2028, 2180, 2332, 1112, 1265, 1421, 1573, 1725, 1877, 2029, 2181, 2333, 1113, 1266, 1422, 1574, 1726, 1878, 2030, 2182 or 2334, or a fragment or variant of any one of these nucleic acid sequences. Additional information regarding each of these sequences may also be derived from the sequence listing, in particular from the details provided therein under identifier <223>.

In some embodiments, the artificial nucleic acid further comprises a nucleic acid sequence encoding a molecular tag. More preferably, the molecular tag is selected from the group consisting of a FLAG tag, a glutathione-S-transferase (GST) tag, a His tag, a Myc tag, an E tag, a Strep tag, a green fluorescent protein (GFP) tag and an HA tag.

According to preferred embodiments, the artificial nucleic acid encodes at least one polypeptide comprising or consisting of at least one flavivirus protein, or a fragment or variant thereof, wherein the at least one flavivirus protein, or the fragment or variant thereof, is a YFV protein or a fragment or variant thereof or a DENV protein or a fragment or variant thereof. The description provided herein with respect to a "flavivirus (protein)" reads in its entirety also on a "YFV (protein)" as well as on a "DENV (protein)".

It is also envisaged herein, that the artificial nucleic acid comprises nucleic acid sequences derived from at least two different flaviviruses. For example, the artificial nucleic acid may comprise a nucleic acid sequence derived from YFV and a nucleic acid sequence derived from DENV and encode the respective aa sequences.

According to a preferred embodiment, the artificial nucleic acid is monocistronic, bicistronic or multicistronic.

Preferably, the artificial nucleic acid is monocistronic. In that embodiment, the artificial nucleic acid comprises one coding region, wherein the coding region encodes a polypeptide comprising one or at least two different flavivirus virus proteins, preferably as defined herein, or a fragment or variant thereof.

Alternatively, the artificial nucleic acid can be bi- or multicistronic and comprises at least two coding regions, wherein the at least two coding regions encode at least two polypeptides, wherein each of the at least two polypeptides comprises at least one different flavivirus protein, preferably as described herein, or a fragment or variant of any one of these proteins. For example, the artificial nucleic acid may comprise two coding regions, wherein the first coding region encodes a first polypeptide comprising a first flavivirus protein, or a fragment or variant thereof, and wherein the second coding region encodes a second polypeptide comprising a second flavivirus protein, or a fragment or variant thereof, wherein the first and second flavivirus proteins or a fragment or variant thereof are distinct from each other.

The artificial nucleic acid may further be single stranded or double stranded. When provided as a double stranded nucleic acid, the artificial nucleic acid preferably comprises a sense and a corresponding antisense strand.

Preferably, the artificial nucleic acid as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

The artificial nucleic acid may be provided as DNA or as RNA, preferably an RNA as defined herein. More preferably, the artificial nucleic acid is an artificial mRNA.

The artificial RNA according to the present invention may be prepared using any method known in the art, including chemical synthesis such as e.g. solid phase RNA synthesis, as well as in vitro methods, such as RNA in vitro transcription reactions.

In a preferred embodiment, the artificial nucleic acid as defined herein, preferably the RNA as defined herein, is obtained by RNA in vitro transcription. Accordingly, the RNA of the invention is preferably an in vitro transcribed RNA.

The terms "RNA in vitro transcription" or "in vitro transcription" relate to a process wherein RNA is synthesized in a cell-free system (in vitro) as defined above. DNA, particularly plasmid DNA (or PCR product), is typically used as template for the generation of RNA transcripts.

In the context of nucleic acid production, it may be required to provide GMP-grade RNA. GMP-grade RNA may be suitably produced using a manufacturing process approved by regulatory authorities. Accordingly, in a particularly preferred embodiment, RNA production is performed under current good manufacturing practice (GMP), implementing various quality control steps on DNA and RNA level, according to WO2016/180430. Accordingly, the RNA of the invention is a GMP-grade RNA, particularly a GMP-grade mRNA.

The obtained RNA products are preferably purified using PureMessenger® (CureVac, Tübingen, Germany; RP-HPLC according to WO2008/077592) and/or tangential flow filtration (as described in WO2016/193206).

In a preferred embodiment, the RNA, particularly the purified RNA, is lyophilized according to WO2016/165831 or WO2011/069586 to yield a temperature stable dried artificial nucleic acid (powder) as defined herein. The RNA of the invention, particularly the purified RNA may also be dried using spray-drying or spray-freeze drying according to WO2016/184575 or WO2016184576 to yield a temperature stable artificial nucleic acid (powder) as defined herein. Accordingly, in the context of manufacturing and purifying nucleic acids, particularly RNA, the disclosures of WO2017/109161, WO2015/188933, WO2016/180430, WO2008/077592, WO2016/193206, WO2016/165831, WO2011/069586, WO2016/184575, and WO2016/184576 are incorporated herewith by reference.

Accordingly, in preferred embodiments the RNA is a dried RNA, particularly a dried mRNA.

The term "dried RNA" as used herein has to be understood as RNA that has been lyophilized, or spray-dried, or spray-freeze dried as defined above to obtain a temperature stable dried RNA (powder).

Accordingly, in preferred embodiments the RNA is a purified RNA, particularly purified mRNA.

The term "purified RNA" as used herein has to be understood as RNA which has a higher purity after certain purification steps (e.g. HPLC, TFF, precipitation steps) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, BSA, pyrophosphatase, restriction endonuclease, DNase), spermidine, abortive RNA sequences, RNA fragments, free nucleotides (modified nucleotides, conventional NTPs, cap analogue), plasmid DNA fragments, buffer components (HEPES, TRIS, MgCl2) etc. Other impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full length RNA transcripts is as close as possible to 100%. Accordingly "purified RNA" as used herein has a degree of purity of more than 70%, 75%, 80%, 85%, very particularly 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

It has to be understood that "dried RNA" as defined herein and "purified RNA" as defined herein or "GMP-grade mRNA" as defined herein may have superior stability characteristics and improved efficiency (e.g. better translatability of the mRNA in vivo).

According to one embodiment, the artificial nucleic acid as defined herein, may be in the form of a modified nucleic acid, preferably a modified mRNA, wherein any modification, as defined herein, may be introduced into the artificial nucleic acid. Modifications as defined herein preferably lead to a stabilized artificial nucleic acid, preferably a stabilized artificial RNA, of the present invention.

According to one embodiment, the artificial nucleic acid, preferably an mRNA, may thus be provided as a "stabilized nucleic acid", preferably as a "stabilized mRNA", that is to say as a nucleic acid, preferably an mRNA, that is essentially resistant to in vivo degradation (e.g. by an exo- or endo-nuclease). Such stabilization may be effected by providing a "dried RNA" and/or a "purified RNA" as specified herein. Alternatively, or in addition to that, such stabilization can be effected, for example, by a modified phosphate backbone of an artificial mRNA of the present invention. A backbone modification in connection with the present invention is a modification in which phosphates of the backbone of the nucleotides contained in the mRNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized artificial nucleic acids, preferably mRNAs, may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the artificial nucleic acid, preferably an mRNA, as defined herein.
Chemical Modifications:

The terms "nucleic acid modification" as used herein may refer to chemical modifications comprising backbone modifications as well as sugar modifications or base modifications.

In this context, a modified artificial nucleic acid, preferably an mRNA, as defined herein may contain nucleotide analogues/modifications, e.g. backbone modifications, sugar modifications or base modifications. A backbone modification in connection with the present invention is a modification, in which phosphates of the backbone of the nucleotides contained in an artificial nucleic acid, preferably an mRNA, as defined herein are chemically modified. A sugar modification in connection with the present invention is a chemical modification of the sugar of the nucleotides of the artificial nucleic acid, preferably an mRNA, as defined herein. Furthermore, a base modification in connection with the present invention is a chemical modification of the base moiety of the nucleotides of the artificial nucleic acid, preferably an mRNA. In this context, nucleotide analogues or modifications are preferably selected from nucleotide analogues, which are applicable for transcription and/or translation.

In particularly preferred embodiments of the present invention, the nucleotide analogues/modifications which may be incorporated into a modified nucleic acid or particularly into a modified RNA as described herein are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, 06-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate, pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine, 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyl-adenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyl-adenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, 5'-O-(1-thiophosphate)-adenosine, 5'-O-(1-thiophosphate)-cytidine, 5'-O-(1-thiophosphate)-guanosine, 5'-O-(1-thio-phosphate)-uridine, 5'-O-(1-thiophosphate)-pseudouridine, 6-aza-cytidine, 2-thio-cytidine, α-thio-cytidine, Pseudo-iso-cytidine, 5-aminoallyl-uridine, 5-iodouridine, N1-methyl-pseudouridine, 5,6-dihydrouridine, α-thio-uridine, 4-thio-uridine, 6-aza-uridine, 5-hydroxyuridine, deoxy-thymidine, 5-methyl-uridine, Pyrrolo-cytidine, inosine, α-thio-guanos-ine, 6-methyl-guanosine, 5-methyl-cytdine, 8-oxo-guanos-ine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Particularly preferred and suitable in the context of the invention are pseudouridine (p), N1-methylpseudouridine (m1ψ), 5-methylcytosine, and 5-methoxyuridine. Accord-ingly, the artificial nucleic acid as defined herein may comprise at least one modified nucleotide selected from pseudouridine (p), N1-methylpseudouridine (m1L), 5-meth-ylcytosine, and 5-methoxyuridine.

Codon Modified Coding Sequences:

In preferred embodiments, the artificial nucleic acid, particularly the artificial RNA of the invention comprises at least one coding sequence, wherein the at least one coding sequence is codon modified.

The term "codon modified coding sequence" relates to coding sequences that differ in at least one codon (triplets of nucleotides coding for one amino acid) compared to the corresponding wild type coding sequence. Suitably, a codon modified coding sequence in the context of the invention may show improved resistance to in vivo degradation and/or improved stability in vivo, and/or improved translatability in vivo. Codon modifications in the broadest sense make use of the degeneracy of the genetic code wherein multiple codons may encode the same amino acid and may be used inter-changeably to optimize/modify the coding sequence for in vivo applications as outlined above.

In particularly preferred embodiments, the at least one coding sequence of the artificial nucleic acid is a a modified nucleic acid sequence, preferably comprising a coding region comprising a codon modified coding sequence, wherein the codon modified coding sequence is selected from C maximized coding sequence, G/C optimized coding sequence, human codon usage adapted coding sequence, CAI maximized coding sequence, or any combination thereof.

Preferably, the at least one coding region of the artificial nucleic acid comprises or consists of a codon modified nucleic acid sequence as defined by any one of SEQ ID NO: 89-374, 633-954, 1268-1411, 1424-1567, 1576-1719, 1728-1871, 1880-2023, 2032-2175, 2184-2327, 2336-2479, 7908-

26345, 26348-26355, 1260-1267, 1416-1423, 1568-1575, 1720-1727, 1872-1879, 2024-2031, 2176-2183, 2328-2335, or a fragment or variant of any one of these nucleic acid sequences. Additional information regarding each of these nucleic acid sequence sequences may also be derived from the sequence listing, in particular from the details provided therein under identifier <223>, which as to be understood as part of the disclosure of the present invention.

In some embodiments, the codon modified coding sequence is a C maximized coding sequence, wherein the C content of the at least one coding sequence may be increased, preferably maximized, compared to the C content of the corresponding wild type coding sequence. The amino acid sequence encoded by the C maximized coding sequence of the nucleic acid sequence is preferably not modified as compared to the amino acid sequence encoded by the respective wild type nucleic acid coding sequence. The generation of a Cytosine optimized, preferably Cytosine maximized RNA may suitably be carried out using a C maximization method according to WO2015/062738. In this context, the disclosure of WO2015/062738 relating thereto is included herewith by reference. Throughout the disclosure of the invention, including the <223> identifier of the sequence listing, C maximized coding sequences of suitable flavivirus nucleic acid sequences are indicated by the abbre-viation "opt2".

Preferably, the at least one coding region of the artificial nucleic acid comprises or consists of a C-maximized nucleic acid sequence as defined by any one of SEQ ID NO: 159-190, 679-724, 1576-1719, 10542-13175, 26350, or a fragment or variant of any one of these nucleic acid sequences. Additional information regarding each of these nucleic acid sequence sequences may also be derived from the sequence listing, in particular from the details provided therein under identifier <223>, which as to be understood as part of the disclosure of the present invention.

In preferred embodiments, the codon modified coding sequence is a G/C optimized coding sequence, wherein the G/C content of the at least one coding sequence of the invention may be optimized compared to the G/C content of the corresponding wild type coding sequence (herein referred to as "G/C content optimized coding sequence"). "Optimized" in that context refers to a coding sequence wherein the G/C content is preferably increased to the essentially highest possible G/C content. The amino acid sequence encoded by the G/C content optimized coding sequence of the nucleic acid sequence is preferably not modified as compared to the amino acid sequence encoded by the respective flavivirus wild type nucleic acid coding sequence. The generation of a G/C content optimized nucleic acid sequences, e.g. RNA sequence of the present invention as described above may suitably be carried out using a G/C content modification method explained in WO2002/098443. In this context, the disclosure of WO2002/098443 is included in its full scope in the present invention. Throughout the disclosure of the invention, including the <223> identifier of the sequence listing, G/C optimized coding sequences of suitable flavivirus nucleic acid sequences are indicated by the abbreviation "opt1, opt5, opt6, opt11, opt16, opt17".

Preferably, the at least one coding region of the artificial nucleic acid comprises or consists of a G/C optimized nucleic acid sequence as defined by any one of SEQ ID NOs: 89-158, 255-374, 633-678, 817-954, 1268-1411, 1424-1567, 2032-2175, 2184-2327, 2336-2479, 7908-10541, 18444-26345, 26348, 26349, 26353-26355 or a fragment or variant of any one of these nucleic acid sequences. Additional information regarding each of these nucleic acid sequence sequences may also be derived from the sequence listing, in particular from the details provided therein under identifier <223>, which as to be understood as part of the disclosure of the present invention.

According to preferred embodiments, the at least one coding region of the artificial nucleic acid sequence may be modified, wherein the coding sequence may be adapted to the human codon usage (herein referred to as "human codon usage adapted coding sequence"). Codons encoding the same amino acid occur at different frequencies in a subject, e.g. a human. Accordingly, the flavivirus coding sequence of the artificial nucleic acid as defined herein is preferably adapted such that the frequency of the codons encoding the same amino acid corresponds to the naturally occurring frequency of that codon according to the human codon usage. For example, in the case of the amino acid Alanine (Ala), the wild type coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. Such a procedure (as exemplified for Ala) is suitably applied for each amino acid encoded by the coding sequence of the artificial nucleic acid. Throughout the disclosure of the invention, including the <223> identifier of the sequence listing, human codon usage adapted coding sequences of suitable flavivirus nucleic acid sequences are indicated by the abbreviation "opt3".

Preferably, the at least one coding region of the artificial nucleic acid comprises or consists of a human codon usage adapted nucleic acid sequence as defined by any one of SEQ ID NOs: 191-222, 725-770, 1728-1871, 13176-15809, 26351 or a fragment or variant of any one of these nucleic acid sequences. Additional information regarding each of these nucleic acid sequence sequences may also be derived from the sequence listing, in particular from the details provided therein under identifier <223>, which as to be understood as part of the disclosure of the present invention.

According to preferred embodiments, the at least one coding region of the artificial nucleic acid sequence may be modified, wherein the codon adaptation index (CAI) of the modified nucleic acid sequence, in particular the coding region, may be increased or preferably maximised (herein referred to as "CAI maximized coding sequence").

Accordingly, it is preferred that all codons of the wild type flavivirus sequence that are relatively rare in the cell (e.g. a human) are exchanged for a respective codon that is frequent in the cell, wherein the frequent codon encodes the same amino acid as the relatively rare codon. Suitably, the most frequent codons are used for each encoded amino acid. Suitably, the RNA, preferably the original RNA of the present invention comprises at least one coding sequence, wherein the codon adaptation index (CAI) of the at least one coding sequence is at least 0.5, at least 0.8, at least 0.9 or at least 0.95. Most preferably, the codon adaptation index (CAI) of the at least one coding sequence is 1. For example, in the case of the amino acid alanine (Ala) present in the amino acid sequence encoded by the at least one coding sequence of the nucleic acid sequence according to the invention, the wild type coding sequence is adapted in a way that the most frequent human codon "GCC" is always used for said amino acid. Accordingly, such a procedure (as exemplified for Ala) is applied for each amino acid encoded by the coding sequence of the RNA, preferably the original RNA to obtain CAI maximized coding sequences. Throughout the disclosure of the invention including the <223> identifier of the sequence listing, CAI maximized coding sequences of suitable flavivirus nucleic acid sequences are indicated by the abbreviation "opt4".

Preferably, the at least one coding region of the artificial nucleic acid comprises or consists of a CAI maximized coding sequence nucleic acid sequence as defined by any one of SEQ ID NOs: 223-254, 771-816, 1880-2023, 15810-18443, 26352 or a fragment or variant of any one of these nucleic acid sequences. Additional information regarding each of these nucleic acid sequence sequences may also be derived from the sequence listing, in particular from the details provided therein under identifier <223>, which as to be understood as part of the disclosure of the present invention.

Modification of the 5'-End of a Modified Artificial Nucleic Acid:

According to another preferred embodiment of the invention, the artificial nucleic acid, preferably an mRNA, as defined herein, can be modified by the addition of a so-called "5'-cap" structure, which preferably stabilizes the nucleic acid, preferably an mRNA, as described herein.

In a particularly preferred embodiment, the artificial nucleic acid according to the invention, preferably an mRNA, comprises a 5'-cap structure.

A 5'-cap is an entity, typically a modified nucleotide entity, which generally "caps" the 5'-end of a nucleic acid, for example of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in an artificial nucleic acid in this context. Accordingly, a modified artificial nucleic acid, preferably an mRNA, of the present invention may comprise a m7GpppN as 5'-cap, but additionally the modified artificial nucleic acid, preferably an mRNA, typically comprises at least one further modification as defined herein.

Further examples of 5'-cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3' phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (methylation of the ribose of the 2nd nucleotide downstream of the m7G), cap3 (methylation of the ribose of the 3rd nucleotide downstream of the m7G), cap4 (methylation of the ribose of the 4th nucleotide downstream of the m7G), ARCA (anti-reverse CAP analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

A 5'-cap structure may be introduced into the artificial nucleic acid according to the invention by any method known in the art.

In embodiments, a 5'-cap structure is added via enzymatic capping using capping enzymes (e.g. vaccinia virus capping enzymes, commercially available capping kits) to generate cap0 or cap1 or cap2 structures. In other embodiments, the 5'-cap structure (cap0, cap1) is added via enzymatic capping using immobilized capping enzymes, e.g. in a capping reactor (WO2016/193226).

According to one embodiment, the artificial nucleic acid is an in vitro transcribed RNA, which is enzymatically capped, preferably as described herein, after in vitro transcription.

In a preferred embodiment, the 5'-cap structure is added co-transcriptionally using cap-analogues, in an RNA in vitro transcription reaction as described herein.

The term "cap analogue" as used herein will be recognized and understood by the person of ordinary skill in the art, and is for example intended to refer to a non-polymerizable di-nucleotide that has cap functionality in that it facilitates translation or localization, and/or prevents degradation of a nucleic acid, particularly of an RNA molecule, when incorporated at the 5'-end of the nucleic acid. Non-polymerizable means that the cap analogue will be incorporated only at the 5' terminus because it does not have a 5' triphosphate and therefore cannot be extended in the 3' direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g., GpppG); dimethylated cap analogue (e.g., m2,7GpppG), trimethylated cap analogue (e.g., m2,2,7GpppG), dimethylated symmetrical cap analogues (e.g., m7Gpppm7G), or anti reverse cap analogues (e.g., ARCA; m7,2'OmeGpppG, m7,2' dGpppG, m7,3'OmeGpppG, m7,3'dGpppG and their tetraphosphate derivatives). Further cap analogues have been described previously (WO2008/016473, WO2008/157688, WO2009/149253, WO2011/015347, and WO2013/059475). Further suitable cap analogons in that context are described in WO2017/066793, WO2017/066781, WO2017/066791, WO2017/066789, WO2017/066782, WO2017/066797, wherein the disclosures referring to cap analogues are incorporated herewith by reference.

Untranslated Region (UTR):

The artificial nucleic acid according to the present invention comprises an untranslated region (UTR) comprising or consisting of at least one heterologous UTR element.

In a preferred embodiment, the artificial nucleic acid, preferably an mRNA, comprises at least one heterologous 5' or 3'-UTR element. In this context, a heterologous UTR element comprises or consists of a nucleic acid sequence, which is derived from the 5'- or 3'-UTR of any naturally occurring gene or which is derived from a fragment, a homolog or a variant of the 5'- or 3'-UTR of a gene. Even if 5'- or 3'-UTR elements derived from naturally occurring genes are preferred, also synthetically engineered UTR elements may be used in the context of the present invention. As used herein, the term 'heterologous UTR element' typically refers to a 5'-UTR element or a 3'-UTR element, which is heterologous with respect to the at least one coding region of the artificial nucleic acid. In this context, the term 'heterologous' refers to the circumstance that the UTR element and the coding region of the artificial nucleic acid according to the invention are typically not derived from the same gene. The UTR element is typically not derived from the gene, from which the coding region of the artificial nucleic acid is derived. According to a preferred embodiment, a heterologous UTR element as used herein is not derived from the same species or from the same virus strain, from which the coding region of the artificial nucleic acid is derived. More preferably, the artificial nucleic acid comprises at least one 5'-UTR element and/or at least one 3'-UTR element, wherein the 5'-UTR element or the 3'-UTR element is not derived from the flavivirus, from which the coding sequence that encodes the polypeptide comprising the flavivirus protein, or the fragment or variant thereof, is derived. In a preferred embodiment, the artificial nucleic acid comprises a heterologous 5'-UTR element and/or a hetereologous 3'-UTR element, which is not derived from a flavivirus, such as from a YFV or from a DENV.

Preferably, the artificial nucleic acid according to the invention, preferably an mRNA, comprises at least one of the following structural elements: a 5'- and/or 3'-untranslated region element (UTR element), particularly a 5'-UTR element, which comprises or consists of a nucleic acid sequence, which is derived from the 5'-UTR of a TOP gene or from a fragment, homolog or a variant thereof, or a 5'- and/or 3'-UTR element which may be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

According to the invention, it is preferred that the artificial nucleic acid comprises at least one coding region as defined herein and further comprises a 5'-UTR element, preferably as described herein,
a 3'-UTR element, preferably as described herein,
a histone stem-loop, preferably as described herein,
a poly(A) sequence, preferably as described herein, and/or
a poly(C) sequence, preferably as described herein,
    wherein at least one of the 5'-UTR element and the 3'-UTR element is heterologous with respect to the at least one coding region of the artificial nucleic acid.

More preferably, the artificial nucleic acid comprises at least one coding region as defined herein and further comprises a 5'-UTR element, preferably as described herein,
a 3'-UTR element, preferably as described herein,
a histone stem-loop, preferably as described herein,
a poly(A) sequence, preferably as described herein, and/or
a poly(C) sequence, preferably as described herein,
    wherein at least one of the 5'-UTR element and the 3'-UTR element is not derived from a YFV or from a DENV, preferably not from a flavivirus.

According to a preferred embodiment, the artificial nucleic acid according to the invention comprises a 5'-UTR, preferably comprising at least one heterologous 5'-UTR element.

In a particularly preferred embodiment, the artificial nucleic acid comprises at least one 5'-UTR comprising a heterologous 5'-untranslated region element (5'-UTR element), which comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the artificial nucleic acid is provided by the at least one coding region.

The nucleic acid sequence, which is derived from the 5'-UTR of a TOP gene, is typically derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than *Homo sapiens*, which are homologous to the sequences according to SEQ ID NOs: 1-1363, SEQ ID NO: 1395, SEQ ID NO: 1421 and SEQ ID NO: 1422 of the patent application WO2013/143700.

In a preferred embodiment, the 5'-UTR element of the artificial nucleic acid, preferably an mRNA, comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5'-UTR element is derived from a nucleic acid sequence extending from the nucleotide position immediately 3' to the 5'TOP to the nucleotide position immediately 5' to the start codon (located at the 3'-end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs: 1-1363, SEQ ID NO: 1395, SEQ ID NO: 1421 and SEQ ID NO: 1422 of the patent application WO2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'-end of the sequences) corresponds to the 5'-UTR of said sequences.

Preferably, the artificial nucleic acid according to the invention comprises a 5'-UTR comprising at least one heterologous 5'-UTR element, wherein the at least one heterologous 5'-UTR element comprises a nucleic acid sequence, which is derived from a 5'-UTR of a TOP gene encoding a ribosomal protein, preferably from a corresponding RNA sequence, or from a homolog, a fragment or a variant thereof, preferably lacking the 5'TOP motif.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO2013/143700, a corresponding RNA sequence, a homolog thereof, or a variant thereof as described herein, preferably lacking the 5'TOP motif.

In a particularly preferred embodiment, the 5'-UTR element comprises or consists of a nucleic acid sequence, which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'TOP of said gene.

Accordingly, in a particularly preferred embodiment, the 5'-UTR element comprises or consists of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1 (5'-UTR of human ribosomal protein Large 32 lacking the 5'-terminal oligopyrimidine tract; corresponding to SEQ ID NO: 1368 of the patent application WO2013/143700) or preferably to a corresponding RNA sequence, such as SEQ ID NO: 2, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1 or more preferably to a corresponding RNA sequence, such as SEQ ID NO: 2, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the artificial nucleic acid according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'TOP of said genes, and wherein optionally the 5'-UTR element starts at its 5'-end with a nucleotide located at position 1, 2, 3, 4, 5, 6, 7, 8, 9 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 6, 7, 8, 9 or 10 upstream of the start codon (A(U/T)G) of the gene it is derived from.

According to a preferred embodiment, the artificial nucleic acid comprises at least one heterologous 5'-UTR element comprising or consisting of a nucleic acid sequence, which is derived from a 5'-UTR of a TOP gene encoding a ribosomal Large protein (RPL), preferably RPL32 or RPL35A, or from a gene selected from the group consisting of HSD17B4, ATP5A1, AIG1, ASAH1, COX6C or ABCB7 (also referred to herein as MDR), or from a homolog, a fragment or variant of any one of these genes, preferably lacking the 5'TOP motif.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), a N-acylsphingosine amidohydrolase (acid ceramidase) 1 gene (ASAH1), or an ATP-Binding Cassette, Sub-Family B (MDR/TAP), Member 7 gene (ABCB7), or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), a vertebrate N-acylsphingosine amidohydrolase (acid ceramidase) 1 gene (ASAH1), or a vertebrate ATP-Binding Cassette, Sub-Family B (MDR/TAP), Member 7 gene (ABCB7), or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), a mammalian N-acylsphingosine ami-do-hydrolase (acid ceramidase) 1 gene (ASAH1), or a mam-malian ATP-Binding Cassette, Sub-Family B (MDR/TAP), Member 7 gene (ABCB7), or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mito-chondrial F1 complex, alpha subunit 1, cardiac muscle (ATP5A1) gene, a human hydroxysteroid (17-beta) dehy-drogenase 4 gene (HSD17B4), a human androgen-induced 1 gene (AIG1), a human cytochrome c oxidase subunit VIc gene (COX6C), a human N-acylsphingosine amidohydro-lase (acid ceramidase) 1 gene (ASAH1), or a human ATP-Binding Cassette, Sub-Family B (MDR/TAP), Member 7 gene (ABCB7), or from a variant thereof, wherein prefer-ably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, or a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

According to a particularly preferred embodiment, the artificial nucleic acid comprises a 5'-UTR comprising at least one heterologous 5'-UTR element, wherein the heter-ologous 5'-UTR element comprises or consists of a nucleic acid sequence according to SEQ ID NO: 1 or 2, or a homolog, a fragment or a variant thereof. Preferably, the at least one heterologous 5'-UTR element comprises or con-sists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to a nucleic acid sequence according to any one of SEQ ID NO: 1 or 2.

In embodiments, the artificial nucleic acid as defined herein, particularly the RNA as defined herein comprises a 5'-UTR element, which may be any 5'-UTR element described in WO2016/107877. In this context, the disclosure of WO2016/107877 relating to 5'-UTR elements/sequences is herewith incorporated by reference. Particularly preferred 5'-UTR elements are nucleic acid sequences according to SEQ ID NOs: 25 to 30 and SEQ ID NOs: 319 to 382 of the patent application WO2016/107877, or fragments or variants of these sequences. In this context, it is particularly preferred that the 5'-UTR element of the RNA sequence according to the present invention comprises or consists of a corresponding RNA sequence of the nucleic acid sequence according SEQ ID NOs: 25 to 30 and SEQ ID NOs: 319 to 382 of the patent application WO2016/107877.

In embodiments, the artificial nucleic acid sequence as defined herein, particularly the RNA as defined herein comprises a 5'-UTR element, which may be any 5'-UTR element as described in WO2017/036580. In this context, the disclosure of WO2017/036580 relating to 5'-UTR elements/sequences is herewith incorporated by reference. Particularly preferred 5'-UTR elements are nucleic acid sequences according to SEQ ID NOs: 1 to 151 of the patent application WO2017/036580, or fragments or variants of these sequences. In this context, it is particularly preferred that the 5'-UTR element of the RNA sequence according to the present invention comprises or consists of a corresponding RNA sequence of the nucleic acid sequence according to SEQ ID NOs: 1 to 151 of the patent application WO2017/036580.

According to a preferred embodiment, the artificial nucleic acid according to the invention comprises a 3'-untranslated region (3'-UTR). More preferably, the artificial nucleic acid according to the invention comprises a 3'-UTR comprising or consisting of at least one heterologous 3'-UTR element, preferably as defined herein.

According to a further preferred embodiment, the artificial nucleic acid, preferably the 3'-UTR, may contain a poly-A tail of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the artificial nucleic acid according to the invention, preferably an mRNA, is derived from a DNA template by in vitro transcription. Alternatively, the poly(A) sequence may also be obtained in vitro by common methods of chemical-synthesis without being necessarily transcribed from a DNA progenitor.

Alternatively, the artificial nucleic acid, preferably an mRNA, optionally comprises a polyadenylation signal, which is defined herein as a signal, which conveys polyadenylation to a (transcribed) mRNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

According to a further preferred embodiment, the artificial nucleic acid of the present invention, preferably the 3'-UTR of the artificial nucleic acid, may contain a poly-C tail of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

In a further preferred embodiment, the artificial nucleic acid according to the invention further comprises at least one 3'-UTR element, which comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

The term "3'-UTR element" refers to a nucleic acid sequence, which comprises or consists of a nucleic acid sequence that is derived from a 3'-UTR or from a variant of a 3'-UTR. A 3'-UTR element in the sense of the present invention may represent the 3'-UTR on a DNA or on an RNA level. Thus, in the sense of the present invention, preferably, a 3'-UTR element may be the 3'-UTR of an mRNA, preferably of an artificial mRNA, or it may be the transcription template for a 3'-UTR of an mRNA. Thus, a 3'-UTR element preferably is a nucleic acid sequence, which corresponds to the 3'-UTR of an mRNA, preferably to the 3'-UTR of an artificial mRNA, such as an mRNA obtained by transcription of a genetically engineered vector construct. Preferably, the 3'-UTR element fulfils the function of a 3'-UTR or encodes a sequence, which fulfils the function of a 3'-UTR.

Preferably, the artificial nucleic acid comprises a 3'-UTR element comprising or consisting of a nucleic acid sequence derived from a 3'-UTR of a gene, which preferably encodes a stable mRNA, or from a homolog, a fragment or a variant of said gene. In particular, the 3'-UTR element may be derivable from a gene that relates to an mRNA with an enhanced half-life (that provides a stable mRNA), for example a 3'-UTR element as defined and described below.

In a particularly preferred embodiment, the 3'-UTR element comprises or consists of a nucleic acid sequence which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a homolog, a fragment or a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene. More preferably, the 3'-UTR element comprises or consists of a nucleic acid sequence which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a homolog, a fragment or a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NOs: 1369-1390 of the patent application WO2013/143700, whose disclosure is incorporated herein by reference, or from a homolog, a fragment or a variant thereof.

In a particularly preferred embodiment, the 3'-UTR element comprises or consists of a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank Accession number NM_000477.5, or from a fragment or variant thereof. More preferably, the 3'-UTR element comprises or consists of a nucleic acid according to SEQ ID NO: 11 or 12 (corresponding to SEQ ID NO: 1369 of the patent application WO2013/143700), or a fragment, homolog or variant thereof.

Most preferably the 3'-UTR element comprises or consists of the nucleic acid sequence derived from a fragment of the human albumin gene according to any one of SEQ ID NO: 13 to 16 (corresponding to SEQ ID NO: 1376 of the patent application WO2013/143700), or a fragment, homolog or variant of any one of these sequences.

In another particularly preferred embodiment, the at least one heterologous 3'-UTR element comprises or consists of a nucleic acid sequence derived from a 3'-UTR of an α-globin gene, preferably a vertebrate α- or β-globin gene, more preferably a mammalian α- or β-globin gene, most preferably a human α- or β-globin gene.

More preferably, the 3'-UTR element comprises or consists of a nucleic acid according to SEQ ID NO: 3 or 4 (corresponding to SEQ ID NO: 1370 of the patent application WO2013/143700), or a homolog, a fragment, or a variant thereof.

Preferably, the at least one heterologous 3'-UTR element comprises or consists of a nucleic acid sequence derived from a 3'-UTR of Homo sapiens hemoglobin, alpha 1 (HBA1). More preferably, the 3'-UTR element comprises or consists of a nucleic acid according to SEQ ID NO: 3 or 4 (corresponding to SEQ ID NO: 1370 of the patent application WO2013/143700), or a homolog, a fragment, or a variant thereof.

In another embodiment, the at least one heterologous 3'-UTR element comprises or consists of a nucleic acid sequence derived from a 3'-UTR of Homo sapiens hemoglobin, alpha 2 (HBA2). More preferably, the 3'-UTR element comprises or consists of a nucleic acid according to SEQ ID NO: 5 or 6 (corresponding to SEQ ID NO: 1371 of the patent application WO2013/143700), or a homolog, a fragment, or a variant thereof.

According to another embodiment, the at least one heterologous 3'-UTR element comprises or consists of a nucleic acid sequence derived from a 3'-UTR of Homo sapiens hemoglobin, beta (HBB). More preferably, the 3'-UTR element comprises or consists of a nucleic acid according to SEQ ID NO: 7 or 8 (corresponding to SEQ ID NO: 1372 of the patent application WO2013/143700), or a homolog, a fragment, or a variant thereof.

The at least one heterologous 3'-UTR element may further comprise or consist of the center, α-complex-binding portion of the 3'-UTR of an α-globin gene, such as of a human α-globin gene, or a homolog, a fragment, or a variant of an α-globin gene, preferably according to SEQ ID NO: 9 or 10 (also referred to herein as "muag") (corresponding to SEQ ID NO: 1393 of the patent application WO2013/143700), or a homolog, a fragment, or a variant thereof.

The term "a nucleic acid sequence which is derived from the 3'-UTR of a [ . . . ] gene" preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'-UTR sequence, i.e. the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an ax-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-UTR of a gene, i.e. the full length variant 3'-UTR sequence of a gene, and sequences corresponding to a fragment of the variant 3'-UTR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

In further embodiments, the artificial nucleic acid as defined herein, particularly the RNA as defined herein comprises a 3'-UTR element, which may be any 3'-UTR element described in WO2016/107877. In this context, the disclosure of WO2016/107877 relating to 3'-UTR elements/ sequences is herewith incorporated by reference. Particularly preferred 3'-UTR elements are SEQ ID NOs: 1 to 24 and SEQ ID NOs: 49 to 318 of the patent application WO2016/107877, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 1 to 24 and SEQ ID NOs: 49 to 318 of the patent application WO2016/107877.

In embodiments, the artificial nucleic acid as defined herein, particularly the RNA as defined herein comprises a 3'-UTR element, which may be any 3'-UTR element as described in WO2017/036580. In this context, the disclosure of WO2017/036580 relating to 3'-UTR elements/sequences is herewith incorporated by reference. Particularly preferred 3'-UTR elements are nucleic acid sequences according to SEQ ID NOs: 152 to 204 of the patent application WO2017/ 036580, or fragments or variants of these sequences. In this context, it is particularly preferred that the 3'-UTR element of the RNA sequence according to the present invention comprises or consists of a corresponding RNA sequence of the nucleic acid sequence according SEQ ID NOs: 152 to 204 of the patent application WO2017/036580.

Preferably, the at least one 5'-UTR element and the at least one 3'-UTR element act synergistically to increase protein production from the artificial nucleic acid as described above.

Histone Stem-Loop:

In a particularly preferred embodiment, the artificial nucleic acid as described herein comprises a histone stem-loop sequence/structure. The term "histone stem-loop" as used herein will be recognized and understood by the person of ordinary skill in the art, and is for example intended to refer to nucleic acid sequences that are predominantly found in histone mRNAs. Exemplary histone stem-loop sequences are described in Lopez et al. (Davila Lopez, M., & Samuelsson, T. (2008), RNA, 14(1)). The stem-loops in histone pre-mRNAs are typically followed by a purine-rich sequence known as the histone downstream element (HDE). These pre-mRNAs are processed in the nucleus by a single endonucleolytic cleavage approximately 5 nucleotides downstream of the stem-loop, catalyzed by the U7 snRNP through base pairing of the U7 snRNA with the HDE.

Such histone stem-loop sequences are preferably selected from histone stem-loop sequences as disclosed in WO2012/019780, the disclosure relating to histone stem-loop sequences/structures incorporated herewith by reference.

A histone stem-loop sequence suitable to be used within the present invention is preferably derived from formulae (I) or (II) of the patent application WO2012/019780, herewith incorporated by reference. According to a further preferred embodiment the RNA as defined herein may comprise at least one histone stem-loop sequence derived from at least one of the specific formulae (Ia) or (IIa) of the patent application WO2012/019780.

A particular preferred histone stem-loop sequence is the nucleic acid sequence according to SEQ ID NO: 17 or more preferably the corresponding RNA sequence according to SEQ ID NO: 18.

It has to be noted that any of the above described modifications may be applied to the artificial nucleic acid of the present invention, and further to any nucleic acid as used in the context of the present invention and may be, if suitable or necessary, be combined with each other in any combination, provided, these combinations of modifications do not interfere with each other in the artificial nucleic acid. A person skilled in the art will be able to take his choice accordingly.

mRNA Constructs:

The artificial nucleic acid as defined herein, may preferably comprise a 5'-UTR, a coding region encoding the at least one polypeptide comprising at least one flavivirus protein as described herein, or a fragment, variant or derivative thereof; and/or a 3'-UTR preferably containing at least one histone stem-loop, wherein the artificial nucleic acid comprises an untranslated region comprising at least one heterologous UTR element. The 3'-UTR of the artificial nucleic acid preferably comprises also a poly(A) and/or a poly(C) sequence as defined herein. The single elements of the 3'-UTR may occur therein in any order from 5' to 3' along the sequence of the artificial nucleic acid. In addition, further elements as described herein, may also be contained, such as a stabilizing sequence as defined herewithin (e.g. derived from the UTR of a globin gene), IRES sequences, etc. Each of the elements may also be repeated in the artificial nucleic acid according to the invention at least once (particularly in di- or multicistronic constructs), preferably twice or more.

As an example, the single elements may be present in the artificial nucleic acid in the following order:

5'-coding region-histone stem-loop-poly(A)/(C) sequence-3'; or

5'-coding region-poly(A)/(C) sequence-histone stem-loop-3'; or

5'-coding region-histone stem-loop-polyadenylation signal-3'; or

5'-coding region-polyadenylation signal-histone stem-loop-3'; or

5'-coding region-histone stem-loop-histone stem-loop-poly(A)/(C) sequence-3'; or 5'-coding region-histone stem-loop-histone stem-loop-polyadenylation signal-3'; or 5'-coding region-stabilizing sequence-poly(A)/(C) sequence-histone stem-loop-3'; or 5'-coding region-stabilizing sequence-poly(A)/(C) sequence-poly(A)/(C) sequence-histone stem-loop-3'; etc.

According to a preferred embodiment, the artificial nucleic acid comprises, consists of or codes for, preferably in 5' to 3' direction, the following elements:

a) optionally, a 5'-cap structure, preferably m7GpppN, b) a coding region encoding a polypeptide comprising at least one flavivirus, preferably a YFV protein or a DENV protein, as described herein, or a fragment or variant thereof, c) a poly(A) tail, preferably consisting of 10 to 200, 10 to 100, 40 to 80 or 50 to 70 adenosine nucleotides, d) optionally a poly(C) tail, preferably consisting of 10 to 200, 10 to 100, 20 to 70, 20 to 60 or 10 to 40 cytosine nucleotides, and e) optionally a histone stem-loop, preferably comprising the RNA sequence according to SEQ ID NO: 17 or 18.

More preferably, the artificial nucleic acid according to the invention comprises, consists of or codes for, preferably in 5' to 3' direction, the following elements (In the description of the invention, including the Sequence listing <223> identifier, mRNA design as described above indicated as "mRNA product Design1"):

a) optionally, a 5'-cap structure, preferably m7GpppN, b) a coding region encoding a polypeptide comprising at least one flavivirus, preferably a YFV protein or a DENV protein, as described herein, or a fragment or variant thereof, c) a 3'-UTR element comprising a nucleic acid sequence, which is derived from an ax-globin gene, preferably comprising the corresponding RNA sequence of the nucleic acid sequence according to SEQ ID NO: 9 or 10, or a homolog, a fragment or a variant thereof, d) a poly(A) tail, preferably consisting of 10 to 200, 10 to 100, 40 to 80 or 50 to 70 adenosine nucleotides, e) optionally a poly(C) tail, preferably consisting of 10 to 200, 10 to 100, 20 to 70, 20 to 60 or 10 to 40 cytosine nucleotides, and f) optionally a histone stem-loop, preferably comprising the RNA sequence according to SEQ ID NO: 17 or 18.

In a preferred embodiment, the artificial nucleic acid according to the invention comprises or consists of a nucleic acid sequence according to any one of SEQ ID NO: 375-458, 2480-2559, 26356, or a fragment or variant of any of these sequences. Preferably, the artificial nucleic acid according to the invention comprises or consists of a nucleic acid sequence, which is at least 80% identical to any one of SEQ ID NO: 375-458, 2480-2559 or 26356.

According to some embodiments, the artificial nucleic acid according to the invention comprises, consists of or codes for, preferably in 5' to 3' direction, the following elements (In the description of the invention, including the Sequence listing <223> identifier, mRNA design as described above indicated as "mRNA product Design2"):

a) optionally, a 5'-cap structure, preferably m7GpppN, b) a 5'-UTR element, which comprises or consists of a nucleic acid sequence, which is derived from the 5'-UTR of a TOP gene, preferably comprising a nucleic acid sequence according to SEQ ID NO. 1 or 2, or a homolog, a fragment or a variant thereof, c) a coding region encoding a polypeptide comprising at least one flavivirus, preferably a YFV protein or a DENV protein, as described herein, or a fragment or variant thereof, d) a 3'-UTR element comprising a nucleic acid sequence, which is derived from an albumin gene, preferably comprising the corresponding RNA sequence of the nucleic acid sequence according to SEQ ID NO: 13, 14, 15 or 16, or a homolog, a fragment or a variant thereof, e) a poly(A) tail, preferably consisting of 10 to 200, 10 to 100, 40 to 80 or 50 to 70 adenosine nucleotides, f) optionally a poly(C) tail, preferably consisting of 10 to 200, 10 to 100, 20 to 70, 20 to 60 or 10 to 40 cytosine nucleotides, and g) optionally a histone stem-loop, preferably comprising the RNA sequence according to SEQ ID NO: 17 or 18.

In an alternative embodiment the histone stem-loop is located 5' of the poly(A) tail (d or e, respectively) instead of 3' of the poly(A) tail.

In a preferred embodiment, the artificial nucleic acid according to the invention comprises or consists of a nucleic acid sequence according to any one of SEQ ID NO: 459-540, 2560-2639, 26357, or a fragment or variant of any of these sequences. More preferably, the artificial nucleic acid according to the invention comprises or consists of a nucleic acid sequence, which is at least 80% identical to any one of SEQ ID NO: 459-540, 2560-2639 or 26357.

The artificial nucleic acid according to the invention may be prepared by using any suitable method known in the art, including synthetic methods such as e.g. solid phase synthesis, as well as recombinant and in vitro methods, such as in vitro transcription reactions.

Polypeptide:

In a further aspect, the present invention concerns a polypeptide encoded by the artificial nucleic acid as described herein, or a fragment or variant of said polypeptide. Said polypeptide is typically a polypeptide as described herein, preferably a polypeptide comprising or consisting of any one of the aa sequences according to SEQ ID NOs: 23-56, 541-586, 963-1106, 2640-5273, 26346, 955-962, 26346, or a fragment or variant thereof, or a polypeptide comprising or consisting of an aa sequence encoded by any one of the nucleic acid sequences according to SEQ ID NO: 57-374, 587-954, 1116-1259, 1268-1411, 1424-1567, 1576-1719, 1728-1871, 1880-2023, 2032-2175, 2184-2327, 2336-2479, 5274-26345, 26347-26355, 1107-1115, 1260-1267, 1416-1423, 1568-1575, 1720-1727, 1872-1879, 2024-2031, 2176-2183, 2328-2335, 89-374, 633-954, 1268-1411, 1424-1567, 1576-1719, 1728-1871, 1880-2023, 2032-2175, 2184-2327, 2336-2479, 7908-26345, 26348-26355, 1260-1267, 1416-1423, 1568-1575, 1720-1727, 1872-1879, 2024-2031, 2176-2183, 2328-2335, 375-458, 2480-2559, 26356, 459-540, 2560-2639, 26357, or a fragment or variant thereof.

Preferred YFV and DENV Constructs of the Invention:

In the following, preferred DENV and YFV nucleic acid coding sequences, mRNA sequences and polypeptide sequences are provided.

Preferred YFV polypeptide, nucleic acid and mRNA sequences are provided in Table 1. Therein, each row (row 1-6) represents a specific suitable YFV construct of the invention derived from YFV 17D. The protein design is indicated for each row (column "Design"; e.g. for row 1 that is "C-prME"). Accession numbers are provided in the <223> identifier of the respective SEQ ID NOs in the sequence listing. Column "SEQ ID NO: Protein" provides the respective SEQ ID NOs of the protein constructs as provided in the sequence listing (e.g. for "C-prME" in row 1 that is "SEQ ID NO: 39"). Corresponding wild type (wt) coding sequences are provided in column "SEQ ID NO: CDS wt" (e.g. for "C-prME" in row 1 that is "SEQ ID NO: 73"). Modified coding sequences as defined herein are provided in column "SEQ ID NO: CDS modified" (e.g. for "C-prME" in row 1 that is "SEQ ID NO: 105, 143, 175, 207, 239, 271, 303, 335, 351"). Further information e.g. regarding the type of codon modified coding sequence (opt1, opt2, opt3, opt4, opt5, opt6, opt11 etc) is provided in the <223> identifier of the respective SEQ ID NO in the sequence listing. mRNA constructs comprising said coding sequences are provided in column "SEQ ID NO: mRNA product design 1" and column "SEQ ID NO: mRNA product design 2". Further information e.g. regarding the type of coding sequence (wt, opt1, opt2, opt3, opt4, opt5, opt6, opt11 etc) comprised in the mRNA constructs is provided in the <223> identifier of the respective SEQ ID NO in the sequence listing.

TABLE 1

| | | | | Preferred YFV polypeptide, nucleic acid and mRNA sequences | | |
|---|---|---|---|---|---|---|
| Row | Design | SEQ ID NO: Protein | SEQ ID NO: CDS wt | SEQ ID NO: CDS modified | SEQ ID NO: mRNA product design 1 | SEQ ID NO: mRNA product design 2 |
| 1 | C-prME | 39 | 73 | 105, 143, 175, 207, 239, 271, 303, 335, 351 | 376, 384, 394, 402, 410, 418, 426, 434, 442, 449 | 460, 468, 476, 484, 492, 500, 508, 516, 524, 531 |
| 2 | C-prME-NS1 | 40 | 74 | 106, 144, 176, 208, 240, 272, 304, 336, 352 | 377, 385, 395, 403, 411, 419, 427, 435, 443, 450 | 461, 469, 477, 485, 493, 501, 509, 517, 525, 532 |
| 3 | X-SS-prME-XX | 48 | 82 | 120, 152, 184, 216, 248, 280, 312, 344, 360, 372 | 378, 386, 396, 404, 412, 420, 428, 436, 444, 451, 456 | 462, 470, 478, 486, 494, 502, 510, 518, 526, 533, 538 |
| 4 | X-SS-E | 49 | 83 | 121, 153, 185, 217, 249, 281, 313, 345, 361, 373 | 379, 387, 397, 405, 413, 421, 429, 437, 445, 452, 457 | 463, 471, 479, 487, 495, 503, 511, 519, 527, 534, 539 |
| 5 | SS-prME | 51 | 85 | 123, 155, 187, 219, 251, 283, 315, 347, 363 | 381, 391, 399, 407, 415, 423, 431, 439, 447, 454 | 465, 473, 481, 489, 497, 505, 513, 521, 529, 536 |

TABLE 1-continued

| | | | | SEQ ID NO: CDS | SEQ ID NO: mRNA | SEQ ID NO: mRNA |
|---|---|---|---|---|---|---|
| Row | Design | SEQ ID NO: Protein | SEQ ID NO: CDS wt | modified | product design 1 | product design 2 |
| 6 | SS-prME-NS1 | 53 | 86 | 124, 156, 188, 220, 252, 284, 316, 348, 364 | 382, 392, 400, 408, 416, 424, 432, 440, 448, 455 | 466, 474, 482, 490, 498, 506, 514, 522, 530, 537 |

Preferred DENV polypeptide, nucleic acid and mRNA sequences are provided in Table 2. Therein, each row (row 1-77) represents a specific suitable DENV construct of the invention wherein sequences provided in row 1-12 are derived from DENV-1 CYD23, sequences provided in row 13-24 are derived from DENV-2 CYD2-T, sequences provided in row 25-36 are derived from DENV-4, and sequences provided in row 37-77 are derived from DENV-3.

The protein design is indicated for each row (column "protein design", e.g. for row 6 that is "SSopt-prME (F108S)"). Accession numbers are provided in the <223> identifier of the respective SEQ ID NOs in the sequence listing. Column "SEQ ID NO: Protein" provides the respective SEQ ID NOs of the protein constructs as provided in the sequence listing (for "SSopt-prME(F108S)" that is "SEQ ID NO: 983"). The corresponding wild type (wt) coding sequences are provided in column "SEQ ID NO: CDS wt" (e.g. for "SSopt-prME(F108S)" in row 6 that is "SEQ ID NO: 1136"). Modified coding sequences as defined herein are provided in column "SEQ ID NO: CDS modified" (e.g. for "SSopt-prME(F108S)" in row 6 that is "SEQ ID NO: 1288, 1444, 1596, 1748, 1900, 2052, 2204, 2356"). Further information e.g. regarding the type of codon modified coding sequence (opt1, opt2, opt3, opt4, opt5, opt6, opt11 etc) is provided in the <223> identifier of the respective SEQ ID NO in the sequence listing. Respective mRNA constructs comprising said coding sequences are provided in column "SEQ ID NO: mRNA product design 1 and design 2". Further information e.g. regarding the type of coding sequence (wt, opt1, opt2, opt3, opt4, opt5, opt6, opt11 etc) comprised in the mRNA constructs is provided in the <223> identifier of the respective SEQ ID NO in the sequence listing.

TABLE 2

Preferred DENV polypeptide, nucleic acid and mRNA sequences

| Row | Design | SEQ ID NO: Protein | SEQ ID NO: CDS wt | SEQ ID NO: CDS modified | SEQ ID NO: mRNA product design 1 and design 2 |
|---|---|---|---|---|---|
| 1 | SSc-prME | 979 | 1132 | 1284, 1440, 1592, 1744, 1896, 2048, 2200, 2352 | 2480, 2560 |
| 2 | SSc-prME(F108S) | 980 | 1133 | 1285, 1441, 1593, 1745, 1897, 2049, 2201, 2353 | 2481, 2561 |
| 3 | SSc-prMEdelstem_TM-JEV | 981 | 1134 | 1286, 1442, 1594, 1746, 1898, 2050, 2202, 2354 | 2482, 2562 |
| 4 | SSm-EdelTM | 26346 | 26347 | 26348, 26349, 26350, 26351, 26352, 26353, 26354, 26355 | 26356, 26357 |
| 5 | C-P2A-SSc-prME | 982 | 1135 | 1287, 1443, 1595, 1747, 1899, 2051, 2203, 2355 | 2483, 2563 |
| 6 | SSopt-prME(F108S) | 983 | 1136 | 1288, 1444, 1596, 1748, 1900, 2052, 2204, 2356 | 2484, 2564 |
| 7 | SSopt-prME(F96H) | 984 | 1137 | 1289, 1445, 1597, 1749, 1901, 2053, 2205, 2357 | 2485, 2565 |
| 8 | SSopt-prME(S186F) | 985 | 1138 | 1290, 1446, 1598, 1750, 1902, 2054, 2206, 2358 | 2486, 2566 |
| 9 | SSopt-prME(R188L) | 986 | 1139 | 1291, 1447, 1599, 1751, 1903, 2055, 2207, 2359 | 2487, 2567 |
| 10 | SSopt-pr(D104A)MEdelstem_TM, (F108S)-JEV | 987 | 1140 | 1292, 1448, 1600, 1752, 1904, 2056, 2208, 2360 | 2488, 2568 |
| 11 | SSopt-prMEdelstem_TM, (H261N)-JEV | 988 | 1141 | 1293, 1449, 1601, 1753, 1905, 2057, 2209, 2361 | 2489, 2569 |
| 12 | SSopt -prMEdelstem_TM, (R188L), (A267T)-JEV | 989 | 1142 | 1294, 1450, 1602, 1754, 1906, 2058, 2210, 2362 | 2490, 2570 |

TABLE 2-continued

Preferred DENV polypeptide, nucleic acid and mRNA sequences

| Row | Design | SEQ ID NO: Protein | SEQ ID NO: CDS wt | SEQ ID NO: CDS modified | SEQ ID NO: mRNA product design 1 and design 2 |
|---|---|---|---|---|---|
| 13 | SSc-prME | 1006 | 1159 | 1311, 1467, 1619, 1771, 1923, 2075, 2227, 2379 | 2491, 2571 |
| 14 | SSc-prME(F108S) | 1007 | 1160 | 1312, 1468, 1620, 1772, 1924, 2076, 2228, 2380 | 2492, 2572 |
| 15 | SSc-prMEdelstem_TM-JEV | 1008 | 1161 | 1313, 1469, 1621, 1773, 1925, 2077, 2229, 2381 | 2493, 2573 |
| 16 | SSm-EdelTM | 1009 | 1162 | 1314, 1470, 1622, 1774, 1926, 2078, 2230, 2382 | 2494, 2574 |
| 17 | C-P2A-SSc-prME | 1010 | 1163 | 1315, 1471, 1623, 1775, 1927, 2079, 2231, 2383 | 2495, 2575 |
| 18 | SSopt-prME(F108S) | 1011 | 1164 | 1316, 1472, 1624, 1776, 1928, 2080, 2232, 2384 | 2496, 2576 |
| 19 | SSopt-prME(M96H) | 1012 | 1165 | 1317, 1473, 1625, 1777, 1929, 2081, 2233, 2385 | 2497, 2577 |
| 20 | SSopt-prME(S186F) | 1013 | 1166 | 1318, 1474, 1626, 1778, 1930, 2082, 2234, 2386 | 2498, 2578 |
| 21 | SSopt-prME(R188L) | 1014 | 1167 | 1319, 1475, 1627, 1779, 1931, 2083, 2235, 2387 | 2499, 2579 |
| 22 | SSopt-pr(D104A)MEdelstem_TM, (F108S)-JEV | 1015 | 1168 | 1320, 1476, 1628, 1780, 1932, 2084, 2236, 2388 | 2500, 2580 |
| 23 | SSopt-prMEdelstem_TM, (H261N)-JEV | 1016 | 1169 | 1321, 1477, 1629, 1781, 1933, 2085, 2237, 2389 | 2501, 2581 |
| 24 | SSopt - prMEdelstem_TM, (R188L), (A267T)-JEV | 1017 | 1170 | 1322, 1478, 1630, 1782, 1934, 2086, 2238, 2390 | 2502, 2582 |
| 25 | SSc-prME | 1034 | 1187 | 1339, 1495, 1647, 1799, 1951, 2103, 2255, 2407 | 2503, 2583 |
| 26 | SSc-prME(F108S) | 1035 | 1188 | 1340, 1496, 1648, 1800, 1952, 2104, 2256, 2408 | 2504, 2584 |
| 27 | SSc-prMEdelstem_TM-JEV | 1036 | 1189 | 1341, 1497, 1649, 1801, 1953, 2105, 2257, 2409 | 2505, 2585 |
| 28 | SSm-EdelTM | 1037 | 1190 | 1342, 1498, 1650, 1802, 1954, 2106, 2258, 2410 | 2506, 2586 |
| 29 | C-P2A-SSc-prME | 1038 | 1191 | 1343, 1499, 1651, 1803, 1955, 2107, 2259, 2411 | 2507, 2587 |
| 30 | SSopt-prME(F108S) | 1039 | 1192 | 1344, 1500, 1652, 1804, 1956, 2108, 2260, 2412 | 2508, 2588 |
| 31 | SSopt-prME(V96H) | 1040 | 1193 | 1345, 1501, 1653, 1805, 1957, 2109, 2261, 2413 | 2509, 2589 |
| 32 | SSopt-prME(E186F) | 1041 | 1194 | 1346, 1502, 1654, 1806, 1958, 2110, 2262, 2414 | 2510, 2590 |
| 33 | SSopt-prME(R188L) | 1042 | 1195 | 1347, 1503, 1655, 1807, 1959, 2111, 2263, 2415 | 2511, 2591 |
| 34 | SSopt-pr(D104A)MEdelstem_TM, (F108S)-JEV | 1043 | 1196 | 1348, 1504, 1656, 1808, 1960, 2112, 2264, 2416 | 2512, 2592 |
| 35 | SSopt-prMEdelstem_TM, (H261N)-JEV | 1044 | 1197 | 1349, 1505, 1657, 1809, 1961, 2113, 2265, 2417 | 2513, 2593 |
| 36 | SSopt - prMEdelstem_TM, (R188L), (A267T)-JEV | 1045 | 1198 | 1350, 1506, 1658, 1810, 1962, 2114, 2266, 2418 | 2514, 2594 |

TABLE 2-continued

Preferred DENV polypeptide, nucleic acid and mRNA sequences

| Row | Design | SEQ ID NO: Protein | SEQ ID NO: CDS wt | SEQ ID NO: CDS modified | SEQ ID NO: mRNA product design 1 and design 2 |
|---|---|---|---|---|---|
| 37 | SSc-prME | 1066 | 1219 | 1371, 1527, 1679, 1831, 1983, 2135, 2287, 2439 | 2515, 2595 |
| 38 | SSc-prME(F108S) | 1067 | 1220 | 1372, 1528, 1680, 1832, 1984, 2136, 2288, 2440 | 2516, 2596 |
| 39 | SSc-prME(R186L) | 1068 | 1221 | 1373, 1529, 1681, 1833, 1985, 2137, 2289, 2441 | 2517, 2597 |
| 40 | SSc-prME(A265T) | 1069 | 1222 | 1374, 1530, 1682, 1834, 1986, 2138, 2290, 2442 | 2518, 2598 |
| 41 | SSc-prMEdelstem_TM-JEV | 1070 | 1223 | 1375, 1531, 1683, 1835, 1987, 2139, 2291, 2443 | 2519, 2599 |
| 42 | SSm-EdelTM | 1071 | 1224 | 1376, 1532, 1684, 1836, 1988, 2140, 2292, 2444 | 2520, 2600 |
| 43 | C-P2A-SSc-prME | 1072 | 1225 | 1377, 1533, 1685, 1837, 1989, 2141, 2293, 2445 | 2521, 2601 |
| 44 | SSopt-prME | 1073 | 1226 | 1378, 1534, 1686, 1838, 1990, 2142, 2294, 2446 | 2522, 2602 |
| 45 | SSopt-prME(F108S) | 1074 | 1227 | 1379, 1535, 1687, 1839, 1991, 2143, 2295, 2447 | 2523, 2603 |
| 46 | SSopt-prME(H27N) | 1075 | 1228 | 1380, 1536, 1688, 1840, 1992, 2144, 2296, 2448 | 2524, 2604 |
| 47 | SSopt-prME(T76I) | 1076 | 1229 | 1381, 1537, 1689, 1841, 1993, 2145, 2297, 2449 | 2525, 2605 |
| 48 | SSopt-prME(N89D) | 1077 | 1230 | 1382, 1538, 1690, 1842, 1994, 2146, 2298, 2450 | 2526, 2606 |
| 49 | SSopt-prME(Y96H) | 1078 | 1231 | 1383, 1539, 1691, 1843, 1995, 2147, 2299, 2451 | 2527, 2607 |
| 50 | SSopt-prME(K110E) | 1079 | 1232 | 1384, 1540, 1692, 1844, 1996, 2148, 2300, 2452 | 2528, 2608 |
| 51 | SSopt-prME(H149N) | 1080 | 1233 | 1385, 1541, 1693, 1845, 1997, 2149, 2301, 2453 | 2529, 2609 |
| 52 | SSopt-prME(S184F) | 1081 | 1234 | 1386, 1542, 1694, 1846, 1998, 2150, 2302, 2454 | 2530, 2610 |
| 53 | SSopt-prME(R186L) | 1082 | 1235 | 1387, 1543, 1695, 1847, 1999, 2151, 2303, 2455 | 2531, 2611 |
| 54 | SSopt-prME(N240S) | 1083 | 1236 | 1388, 1544, 1696, 1848, 2000, 2152, 2304, 2456 | 2532, 2612 |
| 55 | SSopt-prME(M258L) | 1084 | 1237 | 1389, 1545, 1697, 1849, 2001, 2153, 2305, 2457 | 2533, 2613 |
| 56 | SSopt-prME(H259N) | 1085 | 1238 | 1390, 1546, 1698, 1850, 2002, 2154, 2306, 2458 | 2534, 2614 |
| 57 | SSopt-prME(H259R) | 1086 | 1239 | 1391, 1547, 1699, 1851, 2003, 2155, 2307, 2459 | 2535, 2615 |
| 58 | SSopt-prME(A265T) | 1087 | 1240 | 1392, 1548, 1700, 1852, 2004, 2156, 2308, 2460 | 2536, 2616 |
| 59 | SSopt-prME(S296G) | 1088 | 1241 | 1393, 1549, 1701, 1853, 2005, 2157, 2309, 2461 | 2537, 2617 |
| 60 | SSopt-prME(S311R) | 1089 | 1242 | 1394, 1550, 1702, 1854, 2006, 2158, 2310, 2462 | 2538, 2618 |

TABLE 2-continued

| | | | | SEQ ID NO: mRNA |
| | | | SEQ ID NO: CDS | product design 1 |
| Row | Design | SEQ ID NO: Protein | SEQ ID NO: CDS wt | modified | and design 2 |
|---|---|---|---|---|---|
| | | | Preferred DENV polypeptide, nucleic acid and mRNA sequences | | |
| 61 | SSopt-prME(K321T) | 1090 | 1243 | 1395, 1551, 1703, 1855, 2007, 2159, 2311, 2463 | 2539, 2619 |
| 62 | SSopt-prME(G28C), (H242C) | 1091 | 1244 | 1396, 1552, 1704, 1856, 2008, 2160, 2312, 2464 | 2540, 2620 |
| 63 | SSopt-prME(R186L), (A265T) | 1092 | 1245 | 1397, 1553, 1705, 1857, 2009, 2161, 2313, 2465 | 2541, 2621 |
| 64 | SSopt-pr(D104A)ME(F108S) | 1093 | 1246 | 1398, 1554, 1706, 1858, 2010, 2162, 2314, 2466 | 2542, 2622 |
| 65 | SSopt-pr(D104A)ME(R186L), (A265T) | 1094 | 1247 | 1399, 1555, 1707, 1859, 2011, 2163, 2315, 2467 | 2543, 2623 |
| 66 | SSopt-pr(D104A)ME(F108S), (R186L), (A265T) | 1095 | 1248 | 1400, 1556, 1708, 1860, 2012, 2164, 2316, 2468 | 2544, 2624 |
| 67 | SSopt-prMEdel101-107, (R99P), (F108N) | 1096 | 1249 | 1401, 1557, 1709, 1861, 2013, 2165, 2317, 2469 | 2545, 2625 |
| 68 | SSopt-prMEdelstem_TM-JEV | 1097 | 1250 | 1402, 1558, 1710, 1862, 2014, 2166, 2318, 2470 | 2546, 2626 |
| 69 | SSopt-pr(D104A)MEdelstem_TM, (F108S)-JEV | 1098 | 1251 | 1403, 1559, 1711, 1863, 2015, 2167, 2319, 2471 | 2547, 2627 |
| 70 | SSopt-pr(D104A)MEdelstem_TM, (R186L), (A265T)-JEV | 1099 | 1252 | 1404, 1560, 1712, 1864, 2016, 2168, 2320, 2472 | 2548, 2628 |
| 71 | SSopt-pr(D104A)MEdelstem_TM, (F108S), (R186L), (A265T)-JEV | 1100 | 1253 | 1405, 1561, 1713, 1865, 2017, 2169, 2321, 2473 | 2549, 2629 |
| 72 | SSopt-prMEdelstem_TM, (H259N)-JEV | 1101 | 1254 | 1406, 1562, 1714, 1866, 2018, 2170, 2322, 2474 | 2550, 2630 |
| 73 | SSopt-prMEdelstem_TM, (R186L), (A265T)-JEV | 1102 | 1255 | 1407, 1563, 1715, 1867, 2019, 2171, 2323, 2475 | 2551, 2631 |
| 74 | SSopt-prMEdelstem_TM, del101-107, (R99P), (F108N)-JEV | 1103 | 1256 | 1408, 1564, 1716, 1868, 2020, 2172, 2324, 2476 | 2552, 2632 |
| 75 | SSc-prME-NS1 | 1104 | 1257 | 1409, 1565, 1717, 1869, 2021, 2173, 2325, 2477 | 2553, 2633 |
| 76 | SSm-EdelTM-linker-ferritin | 1105 | 1258 | 1410, 1566, 1718, 1870, 2022, 2174, 2326, 2478 | 2554, 2634 |
| 77 | SStPA-WHbcAg-linker-EdelTM | 1106 | 1259 | 1411, 1567, 1719, 1871, 2023, 2175, 2327, 2479 | 2555, 2635 |

Composition:

In a further aspect, the present invention provides a composition comprising at least one artificial nucleic acid as described herein or at least one polypeptide as described herein, and, optionally, a pharmaceutically acceptable carrier. The inventive composition comprising the artificial nucleic acid or the polypeptide as described herein is preferably a (pharmaceutical) composition or an immunogenic composition as described herein.

In preferred embodiments, the composition, pharmaceutical composition, immunogenic composition may comprise either only one type of artificial nucleic acid or at least two different artificial nucleic acids. In particular, the inventive composition, pharmaceutical composition, immunogenic composition may comprise at least two artificial nucleic acids as described herein, wherein each of the at least two artificial nucleic acids comprises at least one coding region encoding at least one polypeptide comprising a different flavivirus protein as described herein, preferably a YFV protein or a DENV protein, or a fragment or a variant of any one of these proteins. Alternatively, the composition, pharmaceutical composition, immunogenic composition may comprise at least two artificial nucleic acids as described herein, wherein each of the at least two artificial nucleic acids comprises at least one coding region encoding at least one polypeptide comprising at least two different flavivirus proteins as described herein, preferably different YFV proteins or different DENV proteins, or a fragment or a variant of any one of these proteins. In another embodiment, the composition, pharmaceutical composition, immunogenic composition may also comprise at least two different artificial nucleic acids, which are bi- or multicistronic nucleic acids as described herein and wherein each of the artificial nucleic acids encodes at least two polypeptides, each comprising at least one flavivirus protein, or a fragment or variant thereof. Alternatively, the composition, pharmaceutical composition, immunogenic composition may comprise at least two different polypeptides, preferably comprising at least two different flavivirus proteins as described herein, preferably different YFV proteins or different DENV proteins, or a fragment or a variant of any one of these proteins.

Preferably, the inventive composition, pharmaceutical composition, immunogenic composition comprises or consists of at least one artificial nucleic acid or at least one polypeptide as described herein and a pharmaceutically acceptable carrier. The expression "pharmaceutically acceptable carrier" as used herein preferably includes the liquid or non-liquid basis of the inventive composition, which is preferably a pharmaceutical composition or an immunogenic composition. If the inventive composition is provided in liquid form, the carrier will preferably be water, typically pyrogen-free water; isotonic saline or buffered (aqueous) solutions, e.g. phosphate, citrate etc. buffered solutions. Water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, Na2CO3, NaHCO$_3$, Na2SO4, examples of the optional potassium salts include e.g. KCl, KI, KBr, K2CO3, KHCO3, K2SO4, and examples of calcium salts include e.g. CaCl$_2$), CaI2, CaBr2, CaCO3, CaSO4, Ca(OH)2. Furthermore, organic anions of the aforementioned cations may be contained in the buffer.

Furthermore, one or more compatible solid or liquid fillers or diluents or encapsulating compounds may be used as well, which are suitable for administration to a person. The term "compatible" as used herein means that the constituents of the inventive composition are capable of being mixed with the the the at least one artificial nucleic acid of the composition, in such a manner that no interaction occurs, which would substantially reduce the biological activity or the pharmaceutical effectiveness of the inventive composition under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

Further additives, which may be included in the composition, pharmaceutical composition, immunogenic composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

In a preferred embodiment, the composition, which is preferably a pharmaceutical composition or an immunogenic composition, comprises at least one artificial nucleic acid as described herein, wherein the at least one artificial nucleic acid is complexed at least partially with a cationic or polycationic compound and/or a polymeric carrier, preferably a cationic protein or peptide. Accordingly, in a further embodiment of the invention it is preferred that the at least one artificial nucleic acid as defined herein or any other nucleic acid comprised in the inventive (pharmaceutical) composition or in the inventive immunogenic composition is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of the artificial nucleic acid or any other nucleic acid to cationic or polycationic compound and/or with a polymeric carrier; or optionally in a nitrogen/phosphate (N/P) ratio of the artificial nucleic acid or any other nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one artificial nucleic acid to the one or more polycations is in the range of about 0.1 to 10, including a range of about 0.3 to 4, of about 0.5 to 2, of about 0.7 to 2 and of about 0.7 to 1.5.

Preferably, the composition comprises at least one artificial nucleic acid as described herein, which is complexed with one or more polycations and/or a polymeric carrier, and at least one free nucleic acid, wherein the at least one complexed nucleic acid is preferably identical to the at least one artificial nucleic acid according to the present invention. In this context it is particularly preferred that the at least one artificial nucleic acid of the inventive composition is complexed at least partially with a cationic or polycationic compound and/or a polymeric carrier, preferably cationic proteins or peptides. In this context, the disclosure of WO2010/037539 and WO2012/113513 is incorporated herewith by reference. Partially means that only a part of the artificial nucleic acid is complexed with a cationic compound and that the rest of the artificial nucleic acid is (comprised in the inventive pharmaceutical composition or the inventive immunogenic composition) in uncomplexed form ("free").

Preferably, the molar ratio of the complexed nucleic acid to the free nucleic acid is selected from a molar ratio of about 0.001:1 to about 1:0.001, including a ratio of about 1:1. In a preferred embodiment, the invention provides a composition comprising at least one artificial nucleic acid as described herein, wherein the ratio of complexed nucleic acid to free nucleic acid is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), wherein the ratio is most preferably about 1:1 (w/w).

In one embodiment, at least one artificial nucleic acid as defined herein or any other nucleic acid comprised in the (pharmaceutical) composition or in the immunogenic composition can also be associated with a vehicle, transfection or complexation agent for increasing the transfection efficiency and/or the immunostimulatory properties of the at least one artificial nucleic acid or of optionally comprised further included nucleic acids.

In the context of the present invention, a cationic or polycationic compound is preferably selected from any cationic or polycationic compound, suitable for complexing and thereby stabilizing a nucleic acid, particularly the at least one artificial nucleic acid of the composition, e.g. by associating the at least one artificial nucleic acid with the cationic or polycationic compound. Such a cationic or polycationic compound per se does not need to exhibit any adjuvant properties, since an adjuvant property, particularly the capability of inducing an innate immune response, is preferably created upon complexing the at least one artificial nucleic acid with the cationic or polycationic compound. When complexing the at least one artificial nucleic acid with the cationic or polycationic compound, the adjuvant component is formed.

Particularly preferred, cationic or polycationic peptides or proteins (preferably also as component P2 in a polymeric carrier according to formula IV herein) may be selected from protamine, nucleoline, spermine or spermidine, poly-L-lysine (PLL), basic polypeptides, poly-arginine, cell penetrating peptides (CPPs), chimeric CPPs, such as Transportan, or MPG peptides, HIV-binding peptides, Tat, HIV-1 Tat (HIV), Tat-derived peptides, oligoarginines, members of the penetratin family, e.g. Penetratin, Antennapedia-derived peptides (particularly from *Drosophila* antennapedia), pAntp, pIsl, etc., antimicrobial-derived CPPs e.g. Buforin-2, Bac715-24, SynB, SynB(1), pVEC, hCT-derived peptides, SAP, MAP, KALA, PpTG20, Proline-rich peptides, L-oligomers, Arginine-rich peptides, Calcitonin-peptides, FGF, Lactoferrin, poly-L-Lysine, poly-Arginine, histones, VP22 derived or analog peptides, HSV, VP22 (*Herpes simplex*), MAP, KALA or protein transduction domains (PTDs, PpT620, prolin-rich peptides, arginine-rich peptides, lysine-rich peptides, Pep-1, Calcitonin peptide(s), etc.

In a preferred embodiments, the cationic or polycationic compound suitable for complexing the nucleic acid of the invention is protamine.

Further preferred cationic or polycationic proteins or peptides may be derived from formula $Cys\{(Arg)_l;(Lys)_m;$ $(His)_n;(Orn)_o;(Xaa)_x\}Cys$ or $\{(Arg)_l;(Lys)_m;(His)_n;(Orn)_o;$ $(Xaa)_x\}$ of the patent application WO2009/030481 or WO2011/026641, the disclosure of WO2009/030481 and WO2011/026641 relating thereto are incorporated herewith by reference. In a preferred embodiment, the cationic or polycationic proteins or peptides comprises CHHHHHHRRRRHHHHHHC (SEQ ID NO: 26361), $CR_{12}C$ (SEQ ID NO: 26358), $CR_{12}$ (SEQ ID NO: 26359) or $WR_{12}C$ (SEQ ID NO: 26360).

Further preferred cationic or polycationic compounds, which can be used for complexing the at least one artificial nucleic acid according to the invention may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: 0,0-ditetradecanoyl-N-(α-trimethylammonioacetyl)-diethanolamine chloride, CLIP1: rac-[(2,3-dioctadecyloxypropyl)(2-hydroxyethyl)]-dimethylammonium chloride, CLIP6: rac-[2(2,3-dihexadecyloxy-propyl-oxymethyloxy)ethyl]trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc. Association or complexing the at least one artificial nucleic acid of the inventive composition with cationic or polycationic compounds preferably provides adjuvant properties to the at least one artificial nucleic acid and confers a stabilizing effect to the at least one artificial nucleic acid of the adjuvant component by complexation. The procedure for stabilizing the at least one artificial nucleic acid is in general described in EP-A-1083232, the disclosure of which is incorporated by reference into the present invention in its entirety. Particularly preferred as cationic or polycationic compounds are compounds selected from the group consisting of protamine, nucleoline, spermine, spermidine, oligoarginines as defined above, such as Arg7, Arg8, Arg9, Arg7, H3R9, R9H3, H3R9H3, YSSR9SSY, (RKH)4, Y(RKH)2R, etc.

According to preferred embodiments, the artificial nucleic acid, preferably RNA, of the invention comprised in the composition, is complexed or associated with cationic/polycationic compounds, in particular lipids (cationic and/or neutral lipids) thereby forming one or more liposomes, lipoplexes, lipid nanoparticles, and/or nanoliposomes.

Therefore, in some embodiments, the artificial nucleic acid, preferably RNA, of the invention is provided in the form of a lipid-based formulation, in particular in the form of liposomes, lipoplexes, and/or lipid nanoparticles comprising said artificial nucleic acid, preferably RNA (or said other nucleic acid, in particular RNA).

In the context of the present invention, the term "lipid nanoparticle", also referred to as "LNP", is not restricted to any particular morphology, and includes any morphology generated when a cationic lipid and optionally one or more further lipids are combined, e.g. in an aqueous environment and/or in the presence of an RNA. For example, a liposome, a lipid complex, a lipoplex and the like are within the scope of a lipid nanoparticle (LNP).

LNPs typically comprise a cationic lipid and one or more excipient selected from neutral lipids, charged lipids, steroids and polymer conjugated lipids (e.g. PEGylated lipid). The nucleic acid may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the nucleic acids are attached, or in which the one or more nucleic acids are encapsulated. Preferably, the LNP comprising nucleic acids comprises one or more cationic lipids, and one or more stabilizing lipids. Stabilizing lipids include neutral lipids and PEGylated lipids.

In one embodiment, the LNP consists essentially of (i) at least one cationic lipid; (ii) a neutral lipid; (iii) a sterol, e.g., cholesterol; and (iv) a PEG-lipid, e.g. PEG-DMG or PEG-cDMA, in a molar ratio of about 20-60% cationic lipid: 5-25% neutral lipid: 25-55% sterol; 0.5-15% PEG-lipid.

In that context, a preferred sterol is cholesterol. The sterol can be about 10 mol % to about 60 mol % or about 25 mol % to about 40 mol % of the lipid particle. In one embodiment, the sterol is about 10, 15, 20, 25, 30, 35, 40, 45, 50, 55, or about 60 mol % of the total lipid present in the lipid particle. In another embodiment, the LNPs include from about 5% to about 50% on a molar basis of the sterol, e.g., about 15% to about 45%, about 20% to about 40%, about 48%, about 40%, about 38.5%, about 35%, about 34.4%, about 31.5% or about 31% on a molar basis (based upon 100% total moles of lipid in the lipid nanoparticle).

The cationic lipid of an LNP may be cationisable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

The LNP may comprise any further cationic or cationisable lipid, i.e. any of a number of lipid species which carry a net positive charge at a selective pH, such as physiological pH.

Such lipids include, but are not limited to, N,N-dioleyl-N,N-dimethylammonium chloride (DODAC); N-(2,3-dioleyloxy)propyl)-N,N,N-trimethylammonium chloride (DOTMA); N,N-distearyl-N,N-dimethylammonium bromide (DDAB); N-(2,3dioleoyloxy)propyl)-N,N,N-trimethylammonium chloride (DOTAP); 3-(N-(N',N'dimethylaminoethane)-carbamoyl)cholesterol (DC-Chol), N-(1-(2,3-dioleoyloxy)propyl)N-2-(sperminecarboxamido)ethyl)-N,N-dimethylammonium trifluoroacetate (DOSPA), dioctadecylamidoglycyl carboxyspermine (DOGS), 1,2-dioleoyl-3-dimethylammonium propane (DODAP), N,N-dimethyl-2,3-dioleoyloxy)propylamine (DODMA), and N-(1,2dimyristyloxyprop-3-yl)-N,N-dimethyl-N-hydroxyethyl ammonium bromide (DMRIE). In some aspects, the lipid is selected from the group consisting of 98N12-5, C12-200, and ckk-E12.

In one embodiment, the nucleic acids may be formulated in an aminoalcohol lipidoid. Aminoalcohol lipidoids which may be used in the present invention may be prepared by the methods described in U.S. Pat. No. 8,450,298, herein incorporated by reference in its entirety. Ionizable lipids can also be the compounds disclosed in International Publication No. WO2017/075531, hereby incorporated by reference in its entirety.

Additionally, a number of commercial preparations of cationic lipids are available which can be used in the present invention. These include, for example, LIPOFECTIN® (commercially available cationic liposomes comprising DOTMA and 1,2-dioleoyl-sn-3phosphoethanolamine (DOPE), from GIBCO/BRL, Grand Island, N.Y.); LIPO-FECTAMINE® (commercially available cationic liposomes comprising N-(1-(2,3dioleyloxy)propyl)-N-(2-(spermin-ecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.). The following lipids are cationic and have a positive charge at below physiological pH: DODAP, DODMA, DMDMA, 1,2-dilinoleyloxy-N,N-dimethylaminopropane (DLinDMA), 1,2-dilinolenyloxy-N,N-dimethylaminopro-pane (DLenDMA).

The further cationic lipid may also be an amino lipid. Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.Cl), 1,2-dilinoleoyl-3-trimethyl-aminopropane chloride salt (DLin-TAP.Cl), 1,2-dilinoley-loxy-3-(N-methylpiperazino)propane (DLin-MPZ), 3-(N, Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-di-methylaminobutyrate (DLin-MC3-DMA); MC3 (US20100324120).

Other suitable (cationic) lipids are disclosed in WO2009/086558, WO2009/127060, WO2010/048536, WO2010/054406, WO2010/088537, WO2010/129709, WO2011/153493, US2011/0256175, US2012/0128760, US2012/0027803, and U.S. Pat. No. 8,158,601. In that context, the disclosures of WO2009/086558, WO2009/127060, WO2010/048536, WO2010/054406, WO2010/088537, WO2010/129709, WO2011/153493, US2011/0256175, US2012/0128760, US2012/0027803, and U.S. Pat. No. 8,158,601 are incorporated herewith by reference.

The amount of the permanently cationic lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the RNA which is used as cargo. The N/P ratio may be calculated on the basis that, for example, 1 μg RNA typically contains about 3nmol phosphate residues, provided that the RNA exhibits a statistical distribution of bases. The "N"-value of the lipid or lipidoid may be calculated on the basis of its molecular weight and the relative content of perma-nently cationic and—if present—cationisable groups.

In certain embodiments, the LNP comprises one or more additional lipids which stabilize the formation of particles during their formation.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, dia-cylphosphatidylethanolamines, ceramides, sphingomyelins, dihydro sphingomyelins, cephalins, and cerebrosides.

Exemplary neutral lipids include, for example, dis-tearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidyethanol amine (SOPE), and 1,2-dielaidoyl-sn-glycero-3-phophoethanolamine (transDOPE). In one embodiment, the neutral lipid is 1,2-distearoyl-sn-glycero-3phosphocholine (DSPC).

In some embodiments, the LNPs comprise a neutral lipid selected from DSPC, DPPC, DMPC, DOPC, POPC, DOPE and SM. In various embodiments, the molar ratio of the cationic lipid to the neutral lipid ranges from about 2:1 to about 8:1.

LNP in vivo characteristics and behavior can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

In certain embodiments, the LNP comprises an additional, stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)$_{2000}$)carbamyl]-1,2-dimyristyloxlpropyl-3-amine (PEG-c-DMA). In one embodiment, the polyethylene glycol-lipid is PEG-c-DOMG). In other embodiments, the LNPs comprise a PEGylated diacylglycerol (PEG-DAG) such as 1-(monomethoxy-polyethyleneglycol)-2,3-dimyristoylglycerol (PEG-DMG), a PEGylated phosphatidylethanoloamine (PEG-PE), a PEG succinate diacylglycerol (PEG-S-DAG) such as 4-O-(2,3'-di(tetradecanoyloxy)propyl-1-O-(ω-methoxy(polyethoxy) ethyl)butanedioate (PEG-S-DMG), a PEGylated ceramide (PEG-cer), or a PEG dialkoxypropylcarbamate such as ω-methoxy(polyethoxy)ethyl-N-(2,3di(tetradecanoxy)propyl)carbamate or 2,3-di(tetradecanoxy)propyl-N-(ω-methoxy(polyethoxy)ethyl)-carbamate. In various embodiments, the molar ratio of the cationic lipid to the PEGylated lipid ranges from about 100:1 to about 25:1.

The total amount of nucleic acid, particularly the RNA in the lipid nanoparticles varies and may be defined depending on the e.g. RNA to total lipid w/w ratio. In one embodiment of the invention the RNA to total lipid ratio is less than 0.06 w/w, preferably between 0.03 w/w and 0.04 w/w.

According to a preferred embodiment, the composition, the pharmaceutical composition, or the immunogenic composition, comprises the artificial nucleic acid as described herein and a polymeric carrier. A polymeric carrier used according to the invention might be a polymeric carrier formed by disulfide-crosslinked cationic components.

The disulfide-crosslinked cationic components may be the same or different from each other. The polymeric carrier can also contain further components. It is also particularly preferred that the polymeric carrier used in the composition according to the present invention comprises mixtures of cationic peptides, proteins or polymers and optionally further components as defined herein, which are crosslinked by disulfide bonds as described herein.

Particularly preferred are polymeric carriers comprising cationic peptides according to formula $\{(Arg)_l;(Lys)_m;(His)_n;(Orn)_o;(Xaa)_x(Cys)_y\}$ and/or formula $Cys_1\{(Arg)_l;(Lys)_m;(His)_n;(Orn)_o;(Xaa)_x\}Cys_2$ of the patent application WO2012/013326, the disclosure of WO2012/013326 relating thereto incorporated herewith by reference or polymeric carriers comprising cationic peptides according to formula $Cys\{(Arg)_l;(Lys)_m;(His)_n;(Orn)_o;(Xaa)_x\}Cys$ of patent application WO2011026641.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable to complex the at least one artificial nucleic acid as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the at least one artificial nucleic acid or any further nucleic acid comprised in the (pharmaceutical) composition or in the immunogenic composition contains at least one —SH moiety, most preferably at least one cysteine residue or any further chemical group exhibiting an —SH moiety, capable to form a disulfide linkage upon condensation with at least one further cationic or polycationic protein, peptide or polymer as cationic component of the polymeric carrier as mentioned herein.

As defined above, the polymeric carrier, which may be used to complex the at least one artificial nucleic acid or any further nucleic acid comprised in the (pharmaceutical) composition or in the immunogenic composition may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined above for complexation agent.

In that context, the polymeric carrier which may be used to complex the nucleic acid as defined herein or any further nucleic acid comprised in the (pharmaceutical) composition or in the immunogenic composition according to the invention may be selected from a polymeric carrier molecule according to generic formula $L-P^1—S—[S—P^2—S]_n—S—P^3-L$ of the patent application WO2011/026641 or $L_1-P_1—[P—]_n—P_3—L_2$ of the patent application PCT/EP2017/064059, the disclosure of WO2011/026641 and PCT/EP2017/064059 relating thereto are incorporated herewith by reference.

In a particularly preferred embodiment, the polymeric carrier is a peptide polymer, preferably a polyethylene glycol/peptide polymer comprising HO-PEG$_{5000}$-S—(S—CHHHHHHRRRRHHHHHHC-S-)$_7$-S-PEG$_{5000}$-OH (SEQ ID NO: 26361) and a lipid component, preferably a lipidoid component, more preferably lipidoid 3-C12-OH.

The lipidoid 3-C12-OH (as shown above) may be obtained by acylation of tris(2-aminoethyl)amine with an activated lauric (C12) acid derivative, followed by reduction of the amide. Alternatively, it may be prepared by reductive amination with the corresponding aldehyde. Lipidoid 3-C12-OH is prepared by addition of the terminal C12 alkyl epoxide with the same oligoamine according to Love et al., pp. 1864-1869, PNAS, vol. 107 (2010), no. 5 (cf. compound C12 and compound 110 in FIG. 1 of Love et al.). In preferred embodiments, the peptide polymer comprising lipidoid 3-C12-OH as specified above is used to complex the artificial nucleic acid of the invention, in particular RNA, to form complexes having an N/P ratio from about 0.1 to about 20, or from about 0.2 to about 15, or from about 2 to about 15, or from about 2 to about 12, wherein the N/P ratio is defined as the mole ratio of the nitrogen atoms of the basic groups of the cationic peptide or polymer to the phosphate groups of the artificial nucleic acid.

In another embodiment, the polymeric carrier comprises a lipidoid compound according to formula Ia (formula Ia)

wherein

R$_A$ is independently selected for each occurrence an unsubstituted, cyclic or acyclic, branched or unbranched C$_{1-20}$ aliphatic group; a substituted or unsubstituted, cyclic or acyclic, branched or unbranched C$_{1-20}$ heteroaliphatic group; a substituted or unsubstituted aryl; a substituted or unsubstituted heteroaryl;

wherein at least one R$_A$ is

R$_5$ is independently selected for each occurrence of from an unsubstituted, cyclic or acyclic, branched or unbranched C$_{8-16}$ aliphatic; a substituted or unsubstituted aryl; or a substituted or unsubstituted heteroaryl;

each occurrence of x is an integer from 1 to 10;

each occurrence of y is an integer from 1 to 10;

or a pharmaceutically acceptable salt thereof.

In that context, the disclosure of the PCT patent application PCT/EP2017/064059 is herewith incorporated by reference.

In other embodiments, the composition, which is preferably a pharmaceutical composition, an immunogenic composition, comprises at least one artificial nucleic acid as described herein, wherein the at least one artificial nucleic acid is complexed or associated with polymeric carriers and, optionally, with at least one lipid component as described in the PCT applications PCT/EP2017/064065, PCT/EP2017/064058. In this context, the disclosures of PCT/EP2017/064065, and PCT/EP2017/064058 is herewith incorporated by reference.

The complexed artificial nucleic acid in the (pharmaceutical) composition or in the immunogenic composition, is preferably prepared according to a first step by complexing the at least one artificial with a cationic or polycationic compound and/or with a polymeric carrier, preferably as defined herein, in a specific ratio to form a stable complex.

In this context, it is highly preferable, that no free cationic or polycationic compound or polymeric carrier or only a negligibly small amount thereof remains in the component of the complexed artificial nucleic acid after complexing the artificial nucleic acid. Accordingly, the ratio of the at least one artificial nucleic acid and the cationic or polycationic compound and/or the polymeric carrier in the component of the complexed at least one artificial nucleic acid is typically selected in a range that the at least one artificial nucleic acid is entirely complexed and no free cationic or polycationic compound or polymeric carrier or only a negligibly small amount thereof remains in the composition.

The composition, pharmaceutical composition, immunogenic composition, comprising at least one artificial nucleic acid or at least one polypeptide according to the invention may be provided in liquid and or in dry (e.g. lyophilized) form. In a preferred embodiment, the artificial nucleic acid or the composition is provided in lyophilized form. The artificial nucleic acid and the composition thus provide a possibility to store (irrespective of the ambient temperature and also without cooling) an artificial nucleic acid and a composition suitable for immunization against a flavivirus infection, such as an infection with a YFV or a DENV) and related disorders. Preferably, the at least one lyophilized artificial nucleic acid is reconstituted in a suitable buffer, advantageously based on an aqueous carrier, e.g. Ringer-Lactate solution, prior to use, such as administration to a subject.

In a further aspect, the invention concerns an immunogenic composition comprising the artificial nucleic acid or the polypeptide as described herein or the inventive composition comprising at least one artificial nucleic acid or at least one polypeptide according to the invention. Therein, the at least one artificial nucleic acid or the at least one polypeptide preferably elicits an adaptive immune response upon administration to a subject.

In a preferred embodiment, the immunogenic composition comprises the at least one artificial nucleic acid or the at least one polypeptide as described herein or the inventive composition comprising at least one artificial nucleic acid or the at least one polypeptide according to the invention and a pharmaceutically acceptable carrier. Accordingly, the inventive immunogenic composition is based on the same components as the inventive composition comprising at least one artificial nucleic acid or the at least one polypeptide according to the invention as defined above. Insofar, it may be referred to the above disclosure defining the inventive composition.

As with the composition according to the present invention, the entities of the immunogenic composition may be provided in liquid and or in dry (e.g. lyophilized) form. They may contain further components, in particular further components allowing for its pharmaceutical use. The inventive immunogenic composition may, e.g., additionally contain a pharmaceutically acceptable carrier and/or further auxiliary substances and additives and/or adjuvants.

The immunogenic composition typically comprises a safe and effective amount of the artificial nucleic acid or of the polypeptide as defined herein. As used herein, "safe and effective amount" means an amount of the artificial nucleic acid or of the polypeptide of the immunogenic composition as defined above, that is sufficient to significantly induce an (adaptive) immune response against a flavivirus protein as described herein. At the same time, however, a "safe and effective amount" is small enough to avoid serious side effects that is to say to permit a sensible relationship between advantage and risk. The determination of these limits typically lies within the scope of sensible medical judgment. In relation to the immunogenic composition, the expression "safe and effective amount" preferably means an amount of the artificial nucleic acid or of the polypeptide that is suitable for stimulating the adaptive immune system in such a manner that no excessive or damaging immune reactions are achieved but, preferably, also no such immune reactions below a measurable level. Such a "safe and effective amount" of the artificial nucleic acid or of the polypeptide of the immunogenic composition as defined above may furthermore be selected, for example in dependence of the type of artificial nucleic acid, e.g. monocistronic, bi- or even multicistronic mRNA, since a bi- or even multicistronic mRNA may lead to a significantly higher expression of the encoded polypeptide(s) than use of an equal amount of a monocistronic mRNA. A "safe and effective amount" of the artificial nucleic acid or the polypeptide of the immunogenic composition as defined above may furthermore vary in connection with the particular objective of the treatment and also with the age and physical condition of the patient to be treated, and similar factors, within the knowledge and experience of the accompanying doctor. The immunogenic composition according to the invention can be used according to the invention for human and also for veterinary medical purposes, as a pharmaceutical composition or as an immunogenic composition.

In a preferred embodiment, the artificial nucleic acid of the composition, immunogenic composition or kit of parts according to the invention is provided in lyophilized form. Preferably, the lyophilized artificial nucleic acid is reconstituted in a suitable buffer, advantageously based on an aqueous carrier, prior to administration, e.g. Ringer-Lactate solution, which is preferred, Ringer solution, a phosphate buffer solution.

According to a preferred embodiment, the buffer suitable for injection may be used as a carrier in the inventive immunogenic composition or for resuspending the inventive immunogenic composition. Such a buffer suitable for injection may contain salts selected from sodium chloride (NaCl), calcium chloride (CaCl2)) and optionally potassium chloride (KCl), wherein further anions may be present additional to the chlorides. CaCl2) can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride (CaCl2)). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

The choice of a pharmaceutically acceptable carrier is determined, in principle, by the manner, in which the immunogenic composition is administered. The immunogenic composition can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, the immunogenic composition may be administered by an intradermal, transdermal, subcutaneous, or intramuscular route, preferably by injection, which may be needle-free and/or needle injection. Compositions are therefore preferably formulated in liquid or solid form. The suitable amount of the immunogenic composition to be administered can be determined by routine experiments with animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the immunogenic composition is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

According to another embodiment, the (pharmaceutical) composition or the immunogenic composition may comprise an adjuvant. An adjuvant may be used, for example, in order to enhance the immunostimulatory properties of the immunogenic composition. In this context, an adjuvant may be understood as any compound, which is suitable to support administration and delivery of the immunogenic composition according to the invention. Furthermore, such an adjuvant may, without being bound thereto, initiate or increase an immune response of the innate immune system, i.e. a non-specific immune response. In other words, when administered, the immunogenic composition according to the invention typically initiates an adaptive immune response due to the at least one polypeptide contained in the immunogenic composition or due to the at least one polypeptide encoded by the artificial nucleic acid contained in the immunogenic composition, respectively. Additionally, the immunogenic composition according to the invention may generate an (supportive) innate immune response due to addition of an adjuvant as defined herein to the immunogenic composition according to the invention.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TDM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl-dodecanoyl-amide hydroacetate); CALCITRIOL™ (1-alpha,25-dihydroxy-vitamin D3); calcium phosphate gel; CAP™ (calcium phosphate nanoparticles); cholera holotoxin, cholera-toxin-A1-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DOC/alum complex (deoxycholic acid sodium salt); Freund's complete adjuvant; Freund's incomplete adjuvant; gamma inulin; Gerbu adjuvant (mixture of: i)N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(b1-4)-N-acetylmuramyl-L-alanyl-D-isoglutamine); imiquimod (1-(2-methypropyl)-1H-imidazo[4,5-c]quinoline-4-amine); ImmTher™ (N-acetylglucosaminyl-N-acetylmuramyl-L-Ala-D-isoGlu-L-Ala-glycerol dipalmitate); DRVs (immunoliposomes prepared from dehydration-rehydration vesicles); interferon-gamma; interleukin-1beta; interleukin-2; interleukin-7; interleukin-12; ISCOMS™; ISCOPREP 7.0.3.TM; liposomes; LOX-ORIBINE™ (7-allyl-8-oxoguanosine); LT oral adjuvant (*E. coli* labile enterotoxin-protoxin); microspheres and microparticles of any composition; MF59™; (squalene-water emulsion); MONTANIDE ISA51™ (purified incomplete Freund's adjuvant); MONTANIDE ISA720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAGO (neuraminidase-galactose oxidase); nanospheres or nanoparticles of any composition; NISVs (non-ionic surfactant vesicles); PLEURAN™ (β-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, AL); STIMULON™ (QS-21); Quil-A (Quil-A saponin); S-28463 (4-amino-otec-dimethyl-2-ethoxymethyl-1H-imidazo[4,5 c]quinoline-1-ethanol); SAF-1™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane® (2,6,10,15,19,23-hexamethyltetracosan and 2,6,10,15,19,23-hexamethyl-2,6,10,14,18,22-tetracosahexane); stearyltyrosine (octadecyltyrosine hydrochloride); Theramid® (N-acetylglucosaminyl-N-acetylmuramyl-L-Ala-D-isoGlu-L-Ala-dipalmitoxypropylamide); Theronyl-MDP (Termurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF59, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-1V150, RSV fusion protein, cdiGMP; and adjuvants suitable as antagonists including CGRP neuropeptide.

Suitable adjuvants may also be selected from cationic or polycationic compounds, preferably as described herein, wherein the adjuvant is preferably prepared upon complexing the at least one artificial nucleic acid of the immunogenic composition with the cationic or polycationic compound. Association or complexing the artificial nucleic acid with cationic or polycationic compounds as defined herein preferably provides adjuvant properties and confers a stabilizing effect to the artificial nucleic acid.

The ratio of the artificial nucleic acid to the cationic or polycationic compound in the adjuvant component may be calculated on the basis of the nitrogen/phosphate ratio (N/P-ratio) of the entire artificial nucleic acid complex, i.e. the ratio of positively charged (nitrogen) atoms of the cationic or polycationic compound to the negatively charged phosphate atoms of the nucleic acids. For example, 1 µg RNA typically contains about 3nmol phosphate residues, provided the RNA exhibits a statistical distribution of bases. Additionally, 1 µg peptide typically contains about x nmol nitrogen residues, dependent on the molecular weight and the number of basic aas. When exemplarily calculated for (Arg)9 (molecular weight 1424 g/mol, 9 nitrogen atoms), 1 µg (Arg)9 contains about 700 pmol (Arg)9 and thus 700× 9=6300 pmol basic aas=6.3 nmol nitrogen atoms. For a mass ratio of about 1:1 RNA/(Arg)9 an N/P ratio of about 2 can be calculated. When exemplarily calculated for protamine (molecular weight about 4250 g/mol, 21 nitrogen atoms, when protamine from salmon is used) with a mass ratio of about 2:1 with 2 µg RNA, 6 nmol phosphate are to be calculated for the RNA; 1 µg protamine contains about 235 pmol protamine molecules and thus 235×21=4935 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/ protamine an N/P ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of nucleic acid:peptide in the complex, and most preferably in the range of about 0.7-1.5.

In a preferred embodiment, the immunogenic composition is obtained in two separate steps in order to obtain both, an efficient immunostimulatory effect and efficient translation of the artificial nucleic acid according to the invention. Therein, a so called "adjuvant component" is prepared by complexing—in a first step—a nucleic acid, preferably an RNA, of the adjuvant component with a cationic or polycationic compound in a specific ratio to form a stable complex. In this context, it is important, that no free cationic or polycationic compound or only a neglibly small amount remains in the adjuvant component after complexing the nucleic acid. Accordingly, the ratio of the nucleic acid, preferably an RNA, and the cationic or polycationic compound in the adjuvant component is typically selected in a range that the artificial nucleic acid is entirely complexed and no free cationic or polycationic compound or only a neglectably small amount remains in the composition. Preferably the ratio of the adjuvant component, i.e. the ratio of the artificial nucleic acid to the cationic or polycationic compound is selected from a range of about 6:1 (w/w) to about 0,25:1 (w/w), more preferably from about 5:1 (w/w) to about 0,5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to a preferred embodiment, the artificial nucleic acid, preferably an mRNA, is added in a second step to the complexed nucleic acid, preferably an RNA, of the adjuvant component in order to form the (immunogenic) composition of the invention. Therein, the artificial nucleic acid is added as free nucleic acid, i.e. nucleic acid, which is not complexed by other compounds. Prior to addition, the free artificial nucleic acid is not complexed and will preferably not undergo any detectable or significant complexation reaction upon the addition of the adjuvant component. This is due to the strong binding of the cationic or polycationic compound to the above described artificial nucleic acid in the adjuvant component. In other words, when the artificial nucleic acid according to the invention, is added to the "adjuvant component", preferably no free or substantially no free cationic or polycationic compound is present, which may form a complex with the free artificial nucleic acid. Accordingly, an efficient translation of the free artificial nucleic acid of the inventive (immunogenic) composition is possible in vivo. Therein, the free artificial nucleic acid may occur, for example, as a mono-, di-, or multicistronic nucleic acid, i.e. an artificial nucleic acid which carries the coding sequences of one or more polypeptides. Such coding sequences in a di-, or even multicistronic nucleic acid may be separated by at least one IRES sequence, e.g. as defined herein.

In a particularly preferred embodiment, the free artificial nucleic acid, which is comprised in the (immunogenic) composition, may be identical or different to the RNA of the adjuvant component of the composition, depending on the specific requirements of therapy. Even more preferably, the artificial nucleic acid, preferably an mRNA, which is comprised in the immunogenic composition, is identical to the RNA of the adjuvant component of the immunogenic composition.

In a particularly preferred embodiment, the (immunogenic) composition comprises the artificial nucleic acid, preferably an mRNA, wherein said artificial nucleic acid is present in the composition partially as free nucleic acid and partially as complexed nucleic acid. Preferably, the artificial nucleic acid, preferably an mRNA, is complexed as described above and the same artificial nucleic acid is then added as free nucleic acid, wherein preferably the compound, which is used for complexing the artificial nucleic acid is not present in free form in the composition at the moment of addition of the free nucleic acid component.

The ratio of the first component (i.e. the adjuvant component comprising or consisting of artificial nucleic acid complexed with a cationic or polycationic compound) and the second component (i.e. the free nucleic acid) may be selected in the composition according to the specific requirements of a particular therapy. Typically, the ratio of the nucleic acid, preferably an RNA, in the adjuvant component and the at least one free artificial nucleic acid, preferably an mRNA, (artificial nucleic acid, preferably mRNA in the adjuvant component: free RNA) of the composition is selected such that a significant stimulation of the innate immune system is elicited due to the adjuvant component. In parallel, the ratio is selected such that a significant amount of the at least one free artificial nucleic acid, preferably an mRNA, can be provided in vivo leading to an efficient translation and concentration of the expressed protein in vivo, e.g. the at least one encoded polypeptide as defined herein. Preferably, the ratio of the mRNA in the adjuvant component: free mRNA in the inventive composition is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of mRNA in the adjuvant component: free mRNA in the inventive composition is selected from a ratio of about 1:1 (w/w).

Additionally or alternatively, the ratio of the first component (i.e. the adjuvant component comprising or consisting of artificial nucleic acid complexed with a cationic or polycationic compound) and the second component (i.e. free artificial nucleic acid) may be calculated on the basis of the nitrogen/phosphate ratio (N/P-ratio) of the entire mRNA complex. In the context of the present invention, an N/P-ratio is preferably in the range of about 0.1-10, preferably in a range of about 0.3-4 and most preferably in a range of about 0.5-2 or 0.7-2 regarding the ratio of mRNA:peptide in the complex, and most preferably in the range of about 0.7-1.5.

Additionally or alternatively, the ratio of the first component (i.e. the adjuvant component comprising or consisting of artificial nucleic acid, preferably mRNA, complexed with a cationic or polycationic compound) and the second component (i.e. free artificial nucleic acid, preferably mRNA) may also be selected in the composition on the basis of the molar ratio of both nucleic acids to each other, i.e. the nucleic acid of the adjuvant component, being complexed with a cationic or polycationic compound and the free nucleic acid of the second component. Typically, the molar ratio of the nucleic acid of the adjuvant component to the free nucleic acid of the second component may be selected such, that the molar ratio suffices the above (w/w) and/or N/P-definitions. More preferably, the molar ratio of the nucleic acid, preferably an mRNA, of the adjuvant component to the free nucleic acid, preferably an mRNA, of the second component may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.9:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.001:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.9 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.9:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, or a range of about 0.01:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.1:1, etc.

Even more preferably, the molar ratio of the artificial nucleic acid, preferably an mRNA, of the adjuvant component to the free nucleic acid, preferably an mRNA, of the second component may be selected e.g. from a range of about 0.01:1 to 1:0.01. Most preferably, the molar ratio of the nucleic acid of the adjuvant component to the free nucleic acid of the second component may be selected e.g. from a molar ratio of about 1:1. Any of the above definitions with regard to (w/w) and/or N/P ratio may also apply.

Suitable adjuvants may furthermore be selected from nucleic acids having the formula GlXmGn or nucleic acid adjuvant having the formula ClXmCn as disclosed in WO2008014979 and WO2009095226, the disclosure relating thereto incorporated herein by reference. particularly preferred immunostimulatory nucleic acid sequences may be selected from nucleic acid sequences being identical, or at least 80%, 85%, 90%, 95%, 96%, 97%, 98%, 99% identical to any one of SEQ ID NOs: 25-33, or a fragment or variant of any of these sequences. Moreover, suitable adjuvants that may be used in that context are provided in WO2016/203025. With respect to suitable adjuvants that may be comprised in order to enhance the immunostimulatory properties of the composition according to the invention, the disclosure of WO2016/203025 is included herewith by reference.

The immunogenic composition can additionally contain one or more auxiliary substances in order to further increase the immunogenicity. A synergistic action of the artificial nucleic acid or polypeptide of the immunogenic composition as defined herein and of an auxiliary substance, which may be optionally be co-formulated (or separately formulated) with the immunogenic composition as described above, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, INF-alpha, IFN-beta, INF-gamma, GM-CSF, G-CSF, M-CSF, LT-beta or TNF-alpha, growth factors, such as hGH. Preferably, such immunogenicity increasing agents or compounds are provided separately (not co-formulated with the inventive immunogenic composition) and administered individually.

The immunogenic composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to the immunogenic composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

According to another aspect, the present invention also provides kits, particularly kits of parts, comprising the artificial nucleic acid according to the invention, the polypeptide according to the invention, the composition comprising at least one artificial nucleic acid according to the invention or the polypeptide as described herein, or the immunogenic composition as described herein, optionally a liquid vehicle for solubilising and optionally technical instructions with information on the administration and dosage of the artificial nucleic acid according or polypeptide as described herein, the composition comprising at least one artificial nucleic acid according to the invention or the polypeptide as described herein, or the immunogenic composition. The technical instructions may contain information about administration and dosage. Such kits, preferably kits of parts, may be applied e.g. for any of the applications or uses mentioned herein, preferably for the use of the artificial nucleic acid or the polypeptide as described herein, the composition comprising at least one artificial nucleic acid according to the invention or the polypeptide as described herein, or the immunogenic composition for the treatment or prophylaxis of a flavivirus infection, preferably a YFV or a DENV infection, or diseases or disorders related thereto. The kits may also be applied for the use of the artificial nucleic acid or polypeptide as described herein, the composition comprising at least one artificial nucleic acid according to the invention or the polypeptide as described herein, or the immunogenic composition for the treatment or prophylaxis of flavivirus infection, preferably a YFV or a DENV infection, or diseases or disorders related thereto, wherein the artificial nucleic acid or the polypeptide as described herein, the composition comprising at least one artificial nucleic acid according to the invention or the polypeptide as described herein, or the immunogenic composition may induce or enhance an immune response in a mammal as defined above. Preferably, the artificial nucleic acid or polypeptide as described herein, the composition comprising at least one artificial nucleic acid or polypeptide according to the invention, or the immunogenic composition is provided in a separate part of the kit, wherein the artificial nucleic acid or the polypeptide as described herein, the composition comprising at least one artificial nucleic acid or polypeptide according to the invention, or the immunogenic composition are preferably lyophilised. More preferably, the kit further contains as a part a vehicle for solubilising the artificial nucleic acid or polypeptide as described herein, the composition comprising at least one artificial nucleic acid or polypeptide according to the invention, or the immunogenic composition, the vehicle preferably being Ringer-lactate solution. Any of the above kits may be used in a treatment or prophylaxis as defined above. More preferably, any of the above kits may be used as an immunogenic composition, preferably as an immunogenic composition against flavivirus infection, preferably a YFV or a DENV infection, or a related disease or disorder.

(Medical) Use and Application:

The present invention furthermore provides several applications and uses of the artificial nucleic acid according to the invention, the polypeptide according to the invention, the (immunogenic) composition comprising at least one artificial nucleic acid according to the invention or at least one polypeptide as described herein, or of kits comprising same. In particular, the (pharmaceutical) composition or the immunogenic composition may be used for human and also for veterinary medical purposes, preferably for human medical purposes, as a pharmaceutical composition in general or as an immunogenic composition.

In a further aspect, the invention provides the artificial nucleic acid according to the invention, the polypeptide according to the invention, the composition comprising at least one artificial nucleic acid according to the invention or the polypeptide as described herein, the immunogenic composition or the kit or kit of parts as described herein for use in a method of prophylactic (pre-exposure prophylaxis or post-exposure prophylaxis) and/or therapeutic treatment of flavivirus infections, preferably YFV infections ("yellow fever") or DENV infections ("dengue fever"), or a disorder related thereto. Consequently, in a further aspect, the present invention is directed to the first medical use of the artificial nucleic acid according to the invention, the polypeptide as described herein, the composition comprising at least one artificial nucleic acid according to the invention or at least one polypeptide as described herein, the immunogenic composition or the kit or kit of parts as defined herein as a medicament. In particular, the invention provides the use of an artificial nucleic acid comprising at least one coding region encoding at least one polypeptide comprising at least one flavivirus protein as defined herein, or a fragment or variant thereof as described herein for the preparation of a medicament.

According to another aspect, the present invention is directed to the second medical use of the artificial nucleic acid according to the invention or the polypeptide as described herein, the composition comprising at least one artificial nucleic acid according to the invention or at least one polypeptide as described herein, the immunogenic composition or the kit or kit of parts as described herein for the treatment of an infection with a flavivirus, preferably a YFV infection ("yellow fever") or a DENV infection ("dengue fever"), or a disorder related to such an infection. In particular, the present invention provides the artificial nucleic acid comprising at least one coding region encoding at least one polypeptide comprising at least one flavivirus protein as defined herein, or a fragment or variant thereof as described herein to be used for the preparation of a medicament, wherein the artificial nucleic acid or the polypeptide as described herein is preferably formulated together with a pharmaceutically acceptable vehicle and an optionally additional adjuvant and an optionally additional further component as defined herein.

As used herein, "a disorder related to a flavivirus infection" may preferably comprise a symptom or a complication of a flavivirus infection, such as YFV infection or DENV infection.

The composition, the immunogenic composition comprising at least one artificial nucleic acid or at least one polypeptide according to the invention can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, sub-cutaneous, or intramuscular injections or intralesional, intracranial, intrapulmonal, intracardial, and sublingual injections. More preferably, the immunogenic composition may be administered by an intradermal, transdermal, sub-cutaneous, or intramuscular route. The immunogenic composition is therefore preferably formulated in liquid (or sometimes in solid) form. Preferably, the immunogenic composition may be administered by conventional needle injection or needle-free jet injection. In other embodiments, the immunogenic composition may be administered by jet injection as defined herein, preferably intramuscularly or intradermally, more preferably intradermally.

In a preferred embodiment, a single dose of the artificial nucleic acid, the polypeptide, the composition or the immunogenic composition comprises a specific amount of the artificial nucleic acid or polypeptide according to the invention. Preferably, the artificial nucleic acid is provided in an amount of at least 10 µg per dose, preferably in an amount of from 40 to 700 µg per dose, more preferably in an amount of from 80 to 400 µg per dose. More specifically, in the case of intradermal injection, which is preferably carried out by using a conventional needle, the amount of the artificial nucleic acid comprised in a single dose is typically at least 100 µg, preferably from 100 µg to 1,000 µg, more preferably from 200 µg to 850 µg, even more preferably from 200 µg to 700 µg. In the case of intradermal injection, which is preferably carried out via jet injection (e.g. using a Tropis device), the amount of the artificial nucleic acid comprised in a single dose is typically at least 80 µg, preferably from 80 µg to 700 µg, more preferably from 80 µg to 400 µg. Moreover, in the case of intramuscular injection, which is preferably carried out by using a conventional needle or via jet injection, the amount of the artificial nucleic acid comprised in a single dose is typically at least 80 µg, preferably from 80 µg to 1,000 µg, more preferably from 80 µg to 850 µg, even more preferably from 80 µg to 700 µg. Depending from application route (e.g. intradermal, intramuscular), application device (e.g. jet injection, needle injection) and/or complexation (e.g. protamine complexation or LNP encapsulation or polymer-lipidoid complexation) the suitable amount of artificial nucleic acid has to be adapted accordingly and will be chosen and defined by the skilled person.

The immunization protocol for the treatment or prophy-laxis of a flavivirus infection, i.e. the immunization of a subject against a flavivirus, such as YFV or DENV, typically comprises a series of single doses or dosages of the immunogenic composition as described herein. A single dosage, as used herein, refers to the initial/first dose, a second dose or any further doses, respectively, which are preferably administered in order to "boost" the immune reaction.

According to a preferred embodiment, the artificial nucleic acid according to the invention or the polypeptide described herein, the composition comprising at least one artificial nucleic acid according to the invention or at least one polypeptide as described herein, the immunogenic composition or the kit or kit of parts is provided for use in treatment or prophylaxis, preferably treatment or prophy-laxis of a flavivirus infection or a related disorder, wherein the treatment or prophylaxis comprises the administration of a further active pharmaceutical ingredient. More preferably, in the case of the immunogenic composition described herein, which is based on the artificial nucleic acid, a polypeptide may be co-administered as a further active pharmaceutical ingredient. For example, at least one flavivirus protein as described herein, or a fragment or variant thereof, may be co-administered in order to induce or enhance an immune response. Likewise, in the case of the immunogenic composition described herein, which is based on the polypeptide as described herein, an artificial nucleic acid as described herein may be co-administered as a further active pharmaceutical ingredient. For example, an artificial nucleic acid as described herein encoding at least one polypeptide as described herein may be co-administered in order to induce or enhance an immune response.

A further component of the immunogenic composition may be an immunotherapeutic agent that can be selected from immunoglobulins, preferably IgGs, monoclonal or polyclonal antibodies, polyclonal serum or sera, etc., most preferably immunoglobulins directed against a flavivirus. Preferably, such a further immunotherapeutic agent may be provided as a peptide/protein or may be encoded by a nucleic acid, preferably by a DNA or an RNA, more preferably an mRNA. Such an immunotherapeutic agent preferably allows providing passive vaccination additional to active immunization triggered by the artificial nucleic acid or by the polypeptide.

In a further aspect the invention provides a method of treating or preventing a disorder, wherein the disorder is preferably an infection with flavivirus, more preferably an infection with YFV or DENV, or a disorder related to an infection with flavivirus, wherein the method comprises administering to a subject in need thereof the artificial nucleic acid according to the invention, the inventive composition comprising at least one artificial nucleic acid according to the invention, the inventive polypeptides as described herein, the inventive composition comprising at least one inventive polypeptide, the inventive immunogenic composition or the inventive kit or kit of parts.

In particular, such a method may preferably comprise the steps of:

a) providing the artificial nucleic acid according to the invention, the composition comprising at least one artificial nucleic acid according to the invention, the polypeptide as described herein, the composition comprising at least one polypeptide, the immunogenic composition or the inventive kit or kit of parts described herein;

b) applying or administering the artificial nucleic acid according to the invention, the composition comprising at least one artificial nucleic acid according to the invention, the polypeptide as described herein, the composition comprising at least one polypeptide, the immunogenic composition or the kit or kit of parts described herein to a tissue or an organism;

c) optionally administering immune globuline against a flavivirus (in form of a protein or mRNA as defined above).

According to a further aspect, the present invention also provides a method for expression of at least one polypeptide comprising at least one flavivirus protein, or a fragment or variant thereof, wherein the method preferably comprises the following steps:

a) providing the artificial nucleic acid comprising at least one coding region encoding at least one polypeptide comprising at least one flavivirus protein, or a fragment or variant thereof, preferably as defined herein, or a composition comprising said artificial nucleic acid; and b) applying or administering the artificial nucleic acid or the inventive composition comprising said artificial nucleic acid to an expression system, e.g. to a cell-free expression system, a cell (e.g. an expression host cell or a somatic cell), a tissue or an organism.

The method may be applied for laboratory, for research, for diagnostic, for commercial production of peptides or proteins and/or for therapeutic purposes. In this context, typically after preparing the artificial nucleic acid as defined herein or of the composition or immunogenic composition as defined herein, it is typically applied or administered to a cell-free expression system, a cell (e.g. an expression host cell or a somatic cell), a tissue or an organism, e.g. in naked or complexed form or as a (pharmaceutical) composition or immunogenic composition as described herein, preferably via transfection or by using any of the administration modes as described herein. The method may be carried out in vitro, in vivo or ex vivo. The method may furthermore be carried out in the context of the treatment of a specific disease, particularly in the treatment of infectious diseases, preferably a flavivirus infection or a related disorder as defined herein.

In this context, in vitro is defined herein as transfection or transduction of the artificial nucleic acid as defined herein or of the (immunogenic) composition as defined herein into cells in culture outside of an organism; in vivo is defined herein as transfection or transduction of the artificial nucleic acid or of the (immunogenic) composition into cells by application of the artificial nucleic acid or of the composition to the whole organism or individual and ex vivo is defined herein as transfection or transduction of the artificial nucleic acid or of the (immunogenic) composition into cells outside of an organism or individual and subsequent application of the transfected cells to the organism or individual.

Likewise, according to another aspect, the present invention also provides the use of the artificial nucleic acid as defined herein or of the composition or immunogenic composition as defined herein, preferably for diagnostic or therapeutic purposes, for expression of an encoded antigenic peptide or protein, e.g. by applying or administering the artificial nucleic acid as defined herein or of the inventive composition or immunogenic composition as defined herein, e.g. to a cell-free expression system, a cell (e.g. an expression host cell or a somatic cell), a tissue or an organism. The use may be applied for a (diagnostic) laboratory, for research, for diagnostics, for commercial production of peptides or proteins and/or for therapeutic purposes. In this context, typically after preparing the artificial nucleic acid as defined herein or of the composition or immunogenic composition as defined herein, it is typically applied or administered to a cell-free expression system, a cell (e.g. an expression host cell or a somatic cell), a tissue or an organism, preferably in naked form or complexed form, or as a (pharmaceutical) composition or immunogenic composition as described herein, preferably via transfection or by using any of the administration modes as described herein. The use may be carried out in vitro, in vivo or ex vivo. The use may furthermore be carried out in the context of the treatment of a specific disease, particularly in the treatment of a flavivirus infection or a related disorder.

In a particularly preferred embodiment, the invention provides the artificial nucleic acid, the polypeptide, the composition or the immunogenic composition for use as defined herein, preferably for use as a medicament, for use in treatment or prophylaxis, preferably treatment or prophylaxis of a flavivirus infection or a related disorder.

According to a preferred embodiment, the at least one polypeptide encoded by the artificial nucleic acid according to the invention applied in an use as defined herein, preferably for use as immunogenic composition, comprises or consists of an aa sequence according to any one of SEQ ID NO: 23-56, 541-586, 963-1106, 2640-5273, 26346, 955-962, or a fragment or variant of any of these sequences.

According to a further preferred embodiment, the at least one coding region of the artificial nucleic acid according to the invention applied in an use as defined herein, preferably for use as immunogenic composition, comprises or consists of a nucleic acid sequence according to any one of SEQ ID NO: 57-374, 587-954, 1116-1259, 1268-1411, 1424-1567, 1576-1719, 1728-1871, 1880-2023, 2032-2175, 2184-2327, 2336-2479, 5274-26345, 26347-26355, 1107-1115, 1260-1267, 1416-1423, 1568-1575, 1720-1727, 1872-1879, 2024-2031, 2176-2183, 2328-2335, or a fragment or variant of any of these sequences, preferably a nucleic acid according to any one of SEQ ID NO: 89-374, 633-954, 1268-1411, 1424-1567, 1576-1719, 1728-1871, 1880-2023, 2032-2175, 2184-2327, 2336-2479, 7908-26345, 26348-26355, 1260-1267, 1416-1423, 1568-1575, 1720-1727, 1872-1879, 2024-2031, 2176-2183, 2328-2335, or a fragment or variant of any of these sequences.

In a particularly preferred embodiment, the artificial nucleic acid according to the invention applied in an use as defined herein, preferably for use as immunogenic composition, comprises or consists of a nucleic acid sequence according to any one of SEQ ID NO: 375-458, 459-540, 2480-2559, 26356, 2560-2639, 26357, or a fragment or variant of any of these sequences, preferably a nucleic acid according to any one of SEQ ID NO: 375-458, 2480-2559, 26356, or a fragment or variant of any of these sequences, more preferably a nucleic acid sequence according to SEQ ID NO: 459-540, 2560-2639, 26357, or a fragment or variant of any of these sequences.

Items of the Invention:

Further preferred embodiments of the present invention are also described by the following items:

Item 1. Artificial nucleic acid comprising a) at least one coding region encoding at least one polypeptide comprising at least one flavivirus protein, wherein the flavivirus protein comprises at least one selected from the group consisting of a capsid protein (C), a premembrane protein (prM), a membrane protein (M), an envelope protein (E) and a non-structural protein, or a fragment or variant of any one of these proteins, and b) optionally an untranslated region (UTR) comprising at least one heterologous UTR element, wherein the flavivirus protein is preferably derived from YFV or from DENV.

Item 2. The artificial nucleic acid according to item 1, wherein the at least one encoded polypeptide comprises a flavivirus envelope protein (E), or a fragment or variant thereof.

Item 3. The artificial nucleic acid according to item 1 or 2, wherein the at least one encoded polypeptide comprises a flavivirus premembrane protein (prM) or a flavivirus membrane protein (M), or a fragment or variant of any one of these proteins.

Item 4. The artificial nucleic acid according to any one of items 1 to 3, wherein the at least one encoded polypeptide comprises, preferably in this order from N-terminus to C-terminus, a flavivirus premembrane protein (prM) or a flavivirus membrane protein (M); and a flavivirus envelope protein (E);

or a fragment or variant of any one of these proteins.

Item 5. The artificial nucleic acid according to any one of items 1 to 4, wherein the at least one encoded polypeptide comprises a flavivirus capsid protein (C) or a fragment or a variant thereof.

Item 6. The artificial nucleic acid according to any one of items 1 to 6, wherein the at least one encoded polypeptide comprises at least one aa sequence according to any one of SEQ ID NO: 23-56, 541-586, 963-1106, 2640-5273, 26346, 955-962, or a fragment or variant of any one of these sequences.

Item 7. The artificial nucleic acid according to any one of items 1 to 6, wherein the at least one coding sequence comprises at least one nucleic acid sequence according to any one of SEQ ID NO: 57-374, 587-954, 375-540, 1116-1259, 1268-1411, 1424-1567, 1576-1719, 1728-1871, 1880-2023, 2032-2175, 2184-2327, 2336-2479, 5274-26345, 2480-2639, 26347-26357, 1107-1115, 1260-1267, 1416-1423, 1568-1575, 1720-1727, 1872-1879, 2024-2031, 2176-2183, 2328-2335, or a fragment or variant of any one of these sequences.

Item 8. The artificial nucleic acid according to any one of items 1 to 7, wherein the artificial nucleic acid is monocistronic, bicistronic or multicistronic.

Item 9. The artificial nucleic acid according to any one of items 1 to 8, wherein the artificial nucleic acid further comprises a heterologous nucleic acid sequence.

Item 10. The artificial nucleic acid according to any one of items 1 to 9, wherein the at least one encoded polypeptide comprises at least one signal sequence, preferably a heterologous signal sequence, or a fragment or variant thereof.

Item 11. The artificial nucleic acid according to item 10, wherein the at least one signal sequence is a signal sequence of a secretory protein or a signal sequence of a membrane protein, or a fragment or variant thereof.

Item 12. The artificial nucleic acid according to item 10 or 11, wherein the at least one signal sequence is derived from a flavivirus protein, preferably from a Japanese Encephalitis virus (JEV) protein, a YFV protein or from a DENV protein, or from a fragment or variant thereof.

Item 13. The artificial nucleic acid according to any one of items 1 to 12, wherein the at least one encoded polypeptide comprises at least one aa sequence, which promotes virus-like particle (VLP) formation.

Item 14. The artificial nucleic acid according to item 13, wherein the aa sequence promoting virus-like particle (VLP) formation is derived from hepatitis B virus core antigen, preferably from Woodchuck hepatitis B virus core antigen (WHbcAg).

Item 15. The artificial nucleic acid according to item 13 or 14, wherein the aa sequence promoting virus-like particle (VLP) formation comprises an aa sequence according to SEQ ID NO: 957, or a fragment or variant thereof.

Item 16. The artificial nucleic acid according to any one of items 13 to 15, wherein the aa sequence promoting virus-like particle (VLP) formation is encoded by a nucleic acid sequence according to any one of SEQ ID NO: 1109, 1262, 1418, 1570, 1722, 1874, 2026, 2178 or 2330, or a fragment or variant of any one of these nucleic acid sequences.

Item 17. The artificial nucleic acid according to any one of items 1 to 16, wherein the at least one encoded polypeptide comprises at least one aa sequence, which promotes antigen clustering and/or formation of nanoparticles.

Item 18. The artificial nucleic acid according to item 17, wherein the aa sequence promoting antigen clustering and/or formation of nanoparticles is derived from ferritin, preferably from *Helicobacter pylori* ferritin, more preferably from *Helicobacter pylori* J99 ferritin.

Item 19. The artificial nucleic acid according to item 17 or 18, wherein the aa sequence promoting antigen clustering and/or formation of nanoparticles comprises an aa sequence according to SEQ ID NO: 956, or a fragment or variant thereof.

Item 20. The artificial nucleic acid according to any one of items 17 to 19, wherein the aa sequence promoting antigen clustering and/or formation of nanoparticles is encoded by a nucleic acid sequence according to any one of SEQ ID NO: 1108, 1261, 1417, 1569, 1721, 1873, 2025, 2177, 2329, or a fragment or variant of any one of these nucleic acid sequences.

Item 21. The artificial nucleic acid according to any one of items 1 to 20, wherein the at least one encoded polypeptide comprises at least one aa sequence, which promotes self-cleavage of the encoded polypeptide.

Item 22. The artificial nucleic acid according to item 21, wherein the aa sequence promoting self-cleavage of the encoded polypeptide is derived from the 2A peptide from foot-and-mouth disease virus.

Item 23. The artificial nucleic acid according to item 21 or 22, wherein the aa sequence promoting self-cleavage of the encoded polypeptide comprises an aa sequence according to SEQ ID NO: 962, or a fragment or variant thereof.

Item 24. The artificial nucleic acid according to any one of items 21 to 23, wherein the aa sequence promoting self-cleavage of the encoded polypeptide is encoded by a nucleic acid sequence according to SEQ ID NO: 1114, 1267, 1423, 1575, 1727, 1879, 2031, 2183, 2335, or a fragment or variant of any one of these nucleic acid sequences.

Item 25. The artificial nucleic acid according to any one of items 1 to 24, wherein the encoded polypeptide, preferably the flavivirus protein, or the fragment or variant thereof, comprises an aa sequence derived from a Japanese Encephalitis virus (JEV) protein.

Item 26. The artificial nucleic acid according to item 25, wherein the aa sequence derived from a JEV protein comprises or consists of an aa sequence according to SEQ ID NO: 958, or a fragment or variant thereof.

Item 27. The artificial nucleic acid according to item 25 or 26, wherein the artificial nucleic acid, preferably the coding region, comprises a nucleic acid sequence according to any one of SEQ ID NO: 1110, 1263, 1419, 1571, 1723, 1875, 2027, 2179 or 2331, or a fragment or variant of any one of these nucleic acid sequences.

Item 28. The artificial nucleic acid according to any one of items 1 to 23, wherein the at least one encoded polypeptide comprises a flavivirus protein or a fragment or variant thereof, preferably a YFV protein or a DENV protein, having at least one mutated furin cleavage site.

Item 29. The artificial nucleic acid according to item 28, wherein the at least one encoded polypeptide comprises an aa sequence according to any one of SEQ ID NO: 987, 1015, 1043, 1093-1095, 1098-1100, or a fragment or variant of any one of these aa sequences.

Item 30. The artificial nucleic acid according to item 28 or 29, comprising a nucleic acid sequence according to any one of SEQ ID NO: 1140, 1168, 1196, 1246-1248, 1251-1253, 1292, 1320, 1348, 1398-1400, 1403-1405, 1448, 1476, 1504, 1554-1556, 1559-1561, 1600, 1628, 1656, 1706-1708, 1711-1713, 1752, 1780, 1808, 1858-1860, 1863-1865, 1904, 1932, 1960, 2010-2012, 2015-2017, 2056, 2084, 2112, 2162-2164, 2167-2169, 2208, 2236, 2264, 2314-2316, 2319-2321, 2360, 2388, 2416, 2466-2468, 2471-2473, or a fragment or variant of any one of these nucleic acid sequences.

Item 31. The artificial nucleic acid according to any one of items 1 to 30, wherein the at least one encoded polypeptide comprises a flavivirus envelope protein, preferably a YFV envelope protein or a DENV envelope protein, or a fragment or a variant thereof.

Item 32. The artificial nucleic acid according to item 31, wherein the aa sequence of the flavivirus envelope protein is modified with respect to the wildtype aa sequence it is derived from.

Item 33. The artificial nucleic acid according to item 31 or 32, wherein the at least one polypeptide comprises an aa sequence according to any one of SEQ ID NO: 29, 49, 50, 968, 975-978, 995, 1002-1005, 1009, 1023, 1030-1033, 1037, 1051, 1060-1065, 1071, 1105, 1106, 26346, or a fragment or variant of any one of these aa sequences.

Item 34. The artificial nucleic acid according to any one of items 31 to 33, comprising a nucleic acid sequence according to any one of SEQ ID NO: 63, 83, 84, 95, 121, 122, 133, 153, 154, 165, 185, 186, 197, 217, 218, 229, 249, 250, 261, 281, 282, 293, 313, 314, 325, 345, 346, 361, 362, 373, 374, 379, 380, 387, 388, 397, 398, 405, 406, 413, 414, 421, 422, 429, 430, 437, 438, 445, 446, 452, 453, 457, 458, 463, 464, 471, 472, 479, 480, 487, 488, 495, 496, 503, 504, 511, 512, 519, 520, 527, 528, 534, 535, 539, 540, 1121, 1128-1131, 1148, 1155-1158, 1162, 1176, 1183-1186, 1190, 1204, 1213-1218, 1224, 1258, 1259, 1273, 1280-1283, 1300, 1307-1310, 1314, 1328, 1335-1338, 1342, 1356, 1365-1370, 1376, 1410, 1411, 1429, 1436-1439, 1456, 1463-1466, 1470, 1484, 1491-1494, 1498, 1512, 1521-1526, 1532, 1566, 1567, 1581, 1588-1591, 1608, 1615-1618, 1622, 1636, 1643-1646, 1650, 1664, 1673-1678, 1684, 1718, 1719, 1733, 1740-1743, 1760, 1767-1770, 1774, 1788, 1795-1798, 1802, 1816, 1825-1830, 1836, 1870, 1871, 1885, 1892-1895, 1912, 1919-1922, 1926, 1940, 1947-1950, 1954, 1968, 1977-1982, 1988, 2022, 2023, 2037, 2044-2047, 2064, 2071-2074, 2078, 2092, 2099-2102, 2106, 2120, 2129-2134, 2140, 2174, 2175, 2189, 2196-2199, 2216, 2223-2226, 2230, 2244, 2251-2254, 2258, 2272, 2281-2286, 2292, 2326, 2327, 2341, 2348-2351, 2368, 2375-2378, 2382, 2396, 2403-2406, 2410, 2424, 2433-2438, 2444, 2478, 2479, 2494, 2506, 2520, 2554, 2555, 2558, 2559, 2574, 2586, 2600, 2634, 2635, 2638, 2639, 26347-26357, or a fragment or variant of any one of these nucleic acid sequences.

Item 35. The artificial nucleic acid according to any one of items 1 to 34, wherein the at least one encoded polypeptide comprises a flavivirus protein, preferably a flavivirus envelope protein, preferably a YFV protein or a DENV protein, or a fragment or variant thereof, comprising at least one mutation that stabilizes the monomeric or the dimeric conformation of the flavivirus protein, or the fragment or variant thereof.

Item 36. The artificial nucleic acid according to item 35, wherein the at least one encoded polypeptide comprises an aa sequence according to any one of SEQ ID NO: 980, 983-989, 1007, 1011-1017, 1035, 1039-1045, 1067-1069, 1074-1096, 1098-1103, or a fragment or variant of any one of these aa sequences.

Item 37. The artificial nucleic acid according to item 35 or 36, comprising a nucleic acid sequence according to any one of SEQ ID NO: 1133, 1136-1142, 1160, 1164-1170, 1188, 1192-1198, 1220-1222, 1227-1249, 1251-1256, 1285, 1288-1294, 1312, 1316-1322, 1340, 1344-1350, 1372-1374, 1379-1401, 1403-1408, 1441, 1444-1450, 1468, 1472-1478, 1496, 1500-1506, 1528-1530, 1535-1557, 1559-1564, 1593, 1596-1602, 1620, 1624-1630, 1648, 1652-1658, 1680-1682, 1687-1709, 1711-1716, 1745, 1748-1754, 1772, 1776-1782, 1800, 1804-1810, 1832-1834, 1839-1861, 1863-1868, 1897, 1900-1906, 1924, 1928-1934, 1952, 1956-1962, 1984-1986, 1991-2013, 2015-2020, 2049, 2052-2058, 2076, 2080-2086, 2104, 2108-2114, 2136-2138, 2143-2165, 2167-2172, 2201, 2204-2210, 2228, 2232-2238, 2256, 2260-2266, 2288-2290, 2295-2317, 2319-2324, 2353, 2356-2362, 2380, 2384-2390, 2408, 2412-2418, 2440-2442, 2447-2469, 2471-2476, 2481, 2484-2490, 2492, 2496-2502, 2504, 2508-2514, 2516-2518, 2523-2545, 2547-2552, 2561, 2564-2570, 2572, 2576-2582, 2584, 2588-2594, 2596-2598, 2603-2625, 2627-2632, or a fragment or variant of any one of these nucleic acid sequences.

Item 38. The artificial nucleic acid according to any one of items 1 to 37, wherein the artificial nucleic acid is an RNA, preferably an mRNA.

Item 39. The artificial nucleic acid according to any one of items 1 to 38, wherein the artificial nucleic acid comprises a 5'-cap structure.

Item 40. The artificial nucleic acid according to any one of items 1 to 39, wherein the G/C content of the at least one coding region is increased compared to the G/C content of the corresponding coding sequence of the wild type mRNA, and wherein the encoded aa sequence is preferably not modified compared to the aa sequence encoded by the corresponding wild type mRNA.

Item 41. The artificial nucleic acid according to any one of items 1 to 40, wherein the at least one coding region comprises a nucleic acid sequence, which is codon-optimized.

Item 42. The artificial nucleic acid according to item 40 or 41, wherein the at least one coding region comprises at least one nucleic acid sequence according to any one of SEQ ID NO: 89-374, 633-954, 1268-1411, 1424-1567, 1576-1719, 1728-1871, 1880-2023, 2032-2175, 2184-2327, 2336-2479, 7908-26345, 26348-26355, 1260-1267, 1416-1423, 1568-1575, 1720-1727, 1872-1879, 2024-2031, 2176-2183, 2328-2335, or a fragment or variant of any one of these nucleic acid sequences.

Item 43. The artificial nucleic acid according to any one of items 1 to 42, wherein the artificial nucleic acid comprises at least one histone stem-loop.

Item 44. The artificial nucleic acid according to item 43, wherein the at least one histone stem-loop comprises a nucleic acid sequence according to SEQ ID NO: 17 or 18.

Item 46. The artificial nucleic acid according to any one of items 1 to 45, wherein the artificial nucleic acid comprises a 3'-UTR.

Item 47. The artificial nucleic acid according to item 46, wherein the 3'-UTR comprises a poly(A) sequence and/or a poly(C) sequence.

Item 48. The artificial nucleic acid according to item 46 or 47, wherein the 3'-UTR comprises at least one heterologous 3'-UTR element.

Item 49. The artificial nucleic acid according to item 48, wherein the at least one heterologous 3'-UTR element comprises a nucleic acid sequence derived from a 3'-UTR of a gene selected from the group consisting of an albumin gene, an ax-globin gene, a β-globin gene, a tyrosine hydroxylase gene, a lipoxygenase gene, and a collagen alpha gene, or a homolog, a fragment or a variant of said nucleic acid sequence.

Item 50. The artificial nucleic acid according to item 48 or 49, wherein the at least one heterologous 3'-UTR element comprises a nucleic acid sequence derived from a 3'-UTR of an α-globin gene, preferably comprising a nucleic acid sequence according to SEQ ID NO: 9 or 10, a homolog, a fragment, or a variant of any one of these nucleic acid sequences.

Item 51. The artificial nucleic acid according to item 48 or 49, wherein the at least one heterologous 3'-UTR element comprises a nucleic acid sequence, which is derived from the 3'-UTR of a vertebrate albumin gene or from a variant thereof, preferably from the 3'-UTR of a mammalian albumin gene or from a variant thereof, more preferably from the 3'-UTR of a human albumin gene or from a variant thereof, even more preferably from the 3'-UTR of the human albumin gene according to GenBank or NCBI Accession number NM_000477.5, or from a fragment or variant thereof.

Item 52. The artificial nucleic acid according to item 51, wherein the at least one heterologous 3'-UTR element comprises a nucleic acid sequence according to any one of SEQ ID NO: 13 to 16, or a homolog, a fragment or a variant of any one of these nucleic acid sequences.

Item 53. The artificial nucleic acid according to any one of items 1 to 52, wherein the artificial nucleic acid comprises a 5'-UTR.

Item 54. The artificial nucleic acid sequence according to item 53, wherein the 5'-UTR comprises at least one heterologous 5'-UTR element.

Item 55. The artificial nucleic acid according to item 54, wherein the at least one heterologous 5'-UTR element comprises a nucleic acid sequence, which is derived from the 5'-UTR of a TOP gene, preferably from a corresponding RNA sequence, or a homolog, a fragment, or a variant thereof, preferably lacking the 5'TOP motif.

Item 56. The artificial nucleic acid according to item 54 or 55, wherein the at least one heterologous 5'-UTR element comprises a nucleic acid sequence, which is derived from a 5'-UTR of a TOP gene encoding a ribosomal protein, preferably from a corresponding RNA sequence, or a homolog, a fragment or a variant of said nucleic acid sequence, preferably lacking the 5'TOP motif.

Item 57. The artificial nucleic acid according to any one of items 54 to 56, wherein the at least one heterologous 5'-UTR element comprises a nucleic acid sequence, which is derived from a 5'-UTR of a TOP gene encoding a ribosomal Large protein (RPL), preferably from RPL32 or from a homolog, a fragment or variant of any one of these genes, preferably lacking the 5'TOP motif.

Item 58. The artificial nucleic acid according to any one of items 54 to 57, wherein the at least one heterologous 5'-UTR element comprises a nucleic acid sequence according to any one of SEQ ID NO. 1 to 2, or a homolog, a fragment or a variant of any one of these nucleic acid sequences.

Item 59. The artificial nucleic acid according to any one of items 1 to 58 comprising, preferably in 5' to 3' direction, the following elements:
  a) 5'-cap structure, preferably m7GpppN,
  b) a coding region encoding a polypeptide comprising at least one flavivirus protein, preferably a YFV protein or a DENV protein, or a fragment or variant thereof;
  c) a 3'-UTR element comprising a nucleic acid sequence, which is derived from an ax-globin gene, preferably comprising the nucleic acid sequence according to SEQ ID NO: 9 or 10, or a homolog, a fragment or a variant of any one of these nucleic acid sequences,
  d) a poly(A) tail, preferably consisting of 10 to 200, 10 to 100, 40 to 80 or 50 to 70 adenosine nucleotides,
  e) optionally a poly(C) tail, preferably consisting of 10 to 200, 10 to 100, 20 to 70, 20 to 60 or 10 to 40 cytosine nucleotides, and
  f) optionally a histone stem-loop, preferably comprising the nucleic acid sequence according to SEQ ID NO: 17 or 18, or a fragment or variant of any one of these nucleic acid sequences.

Item 60. The artificial nucleic acid sequence according to item 59, wherein the coding region comprises a modified nucleic acid sequence, and wherein the coding region preferably comprises a nucleic acid sequence according to any one of SEQ ID NO: 57-374, 587-954, 1116-1259, 1268-1411, 1424-1567, 1576-1719, 1728-1871, 1880-2023, 2032-2175, 2184-2327, 2336-2479, 5274-26345, 26347-26355, 1107-1115, 1260-1267, 1416-1423, 1568-1575, 1720-1727, 1872-1879, 2024-2031, 2176-2183, 2328-2335, more preferably according to any one of SEQ ID NO: 89-374, 633-954, 1268-1411, 1424-1567, 1576-1719, 1728-1871, 1880-2023, 2032-2175, 2184-2327, 2336-2479, 7908-26345, 26348-26355, 1260-1267, 1416-1423, 1568-1575, 1720-1727, 1872-1879, 2024-2031, 2176-2183, 2328-2335, or a fragment or variant of any one of these nucleic acid sequences.

Item 61. The artificial nucleic acid sequence according to item 59 or 60, wherein the artificial nucleic acid comprises a nucleic acid sequence according to any one of SEQ ID NO: 375-458, 2480-2559, 26356, or a fragment or variant of any one of these nucleic acid sequences.

Item 62. The artificial nucleic acid according to any one of items 1 to 60 comprising, preferably in 5' to 3' direction, the following elements:
  a) a 5'-cap structure, preferably m7GpppN,
  b) a 5'-UTR element, which comprises a nucleic acid sequence, which is derived from the 5'-UTR of a TOP gene, preferably comprising a nucleic acid sequence according to SEQ ID NO: 1 or 2, or a homolog, a fragment or a variant of any one of these nucleic acid sequences,
  c) a coding region encoding a polypeptide comprising at least one flavivirus protein, preferably a YFV protein or a DENV protein, or a fragment or variant thereof,
  d) a 3'-UTR element comprising a nucleic acid sequence, which is derived from an albumin gene, preferably comprising the corresponding RNA sequence of the nucleic acid sequence according to any one of SEQ ID NO: 13 to 16, or a homolog, a fragment or a variant of any one of these nucleic acid sequences,
  e) a poly(A) tail, preferably consisting of 10 to 200, 10 to 100, 40 to 80 or 50 to 70 adenosine nucleotides,
  f) optionally a poly(C) tail, preferably consisting of 10 to 200, 10 to 100, 20 to 70, 20 to 60 or 10 to 40 cytosine nucleotides, and
  g) optionally a histone stem-loop, preferably comprising the nucleic acid sequence according to SEQ ID NO: 17 or 18, or a fragment or variant of any one of these nucleic acid sequences.

Item 63. The artificial nucleic acid sequence according to item 62, wherein the coding region comprises a modified nucleic acid sequence, and wherein the coding region preferably comprises a nucleic acid sequence selected from the nucleic acid sequences according to any one of SEQ ID NO: 57-374, 587-954, 1116-1259, 1268-1411, 1424-1567, 1576-1719, 1728-1871, 1880-2023, 2032-2175, 2184-2327, 2336-

2479, 5274-26345, 26347-26355, 1107-1115, 1260-1267, 1416-1423, 1568-1575, 1720-1727, 1872-1879, 2024-2031, 2176-2183, 2328-2335, more preferably according to any one of SEQ ID NO: 89-374, 633-954, 1268-1411, 1424-1567, 1576-1719, 1728-1871, 1880-2023, 2032-2175, 2184-2327, 2336-2479, 7908-26345, 26348-26355, 1260-1267, 1416-1423, 1568-1575, 1720-1727, 1872-1879, 2024-2031, 2176-2183, 2328-2335, or a fragment or variant of any one of these nucleic acid sequences.

Item 64. The artificial nucleic acid sequence according to item 63, wherein the artificial nucleic acid comprises a nucleic acid sequence according to any one of SEQ ID NO: 459-540, 2560-2639, 26357, or a fragment or variant of any one of these nucleic acid sequences.

Item 65. Polypeptide encoded by the artificial nucleic acid according to any one of items 1 to 64.

Item 66. Composition comprising at least one artificial nucleic acid as defined by any one of items 1 to 64, or the polypeptide according to item 65, wherein the composition optionally further comprises a pharmaceutically acceptable carrier.

Item 67. The composition according to item 66, wherein the composition comprises at least two artificial nucleic acids as defined by any one of items 1 to 64, wherein each of the at least two artificial nucleic acids comprises at least one coding region encoding a polypeptide comprising a different flavivirus protein, preferably a different YFV protein or a different DENV protein, or a fragment or a variant thereof.

Item 68. The composition according to item 66 or 67, wherein the composition comprises at least two artificial nucleic acids as defined by any one of items 1 to 60, wherein each of the at least two artificial nucleic acids encodes a polypeptide comprising at least two different flavivirus proteins, preferably different YFV proteins or different DENV proteins, or a fragment or a variant of any one of these proteins.

Item 69A. The composition according to any one of items 66 to 68, wherein the at least one artificial nucleic acid is complexed at least partially with a cationic or polycationic compound and/or a polymeric carrier, preferably a cationic lipid, protein, peptide (e.g. protamine), peptide-polymer, carbohydrate, or a combination thereof.

Item 69B. The composition according to any one of items 66 to 69A, wherein the at least one artificial nucleic acid is complexed with one or more lipids, thereby forming liposomes, lipid nanoparticles, lipoplexes, and/or nanoliposomes.

Item 69C. The composition according to any one of items 66 to 69A, wherein the at least one artificial nucleic acid is complexed with a cationic or polycationic protein or peptide derived from formula $Cys\{(Arg)_i;(Lys)_m;(His)_n;(Orn)_o;(Xaa)_x\}Cys$ or $\{(Arg)_i;(Lys)_m;(His)_n;(Orn)_o;(Xaa)_x\}$, preferably CHHHHHHRRRRHHHHHHC (SEQ ID NO: 26361, CRRRRRRRRRRRRC (SEQ ID NO: 26358), CRRRRRRRRRRRR (SEQ ID NO: 26359), WRRRRRRRRRRRRC (SEQ ID NO: 26360) or a polyethylene glycol/peptide polymer comprising $HO-PEG_{5000}-S—$ $(S—CHHHHHHRRRRHHHHHHC-S-)7-S-PEG_{5000}-OH$ (SEQ ID NO: 26361 of the peptide monomer), and wherein the composition optionally comprises a lipid component, preferably a lipidoid component, wherein the lipidoid compound is a compound according to formula I as described above (formula I)

more preferably lipidoid 3-C12-OH (3-C12-OH)

Item 70. Immunogenic composition comprising the artificial nucleic acid according to any one of items 1 to 64, the polypeptide according to item 65, or the composition according to any one of items 66 to 69.

Item 71. The immunogenic composition according to item 70, wherein the immunogenic composition further comprises a pharmaceutically acceptable carrier.

Item 72. The immunogenic composition according to any item 70 or 71, which further comprises an adjuvant.

Item 73. Kit or kit of parts comprising the artificial nucleic acid according to any one of items 1 to 64, the polypeptide according to item 65, the composition according to any one of items 66 to 69 or the immunogenic composition according to any one of items 70 to 72, optionally a liquid vehicle for solubilising, and optionally technical instructions providing information on administration and dosage of the components.

Item 74. The artificial nucleic acid according to any one of items 1 to 64, the polypeptide according to item 65, the composition according to any one of items 66 to 69, the immunogenic composition according to any one of items 70 to 72, or the kit or kit of parts according to item 73 for use as a medicament.

Item 75. The artificial nucleic acid according to any one of items 1 to 64, the polypeptide according to item 65, the composition according to any one of items 66 to 69, the immunogenic composition according to any one of items 70 to 72, or the kit or kit of parts according to item 73, for use in the treatment or prophylaxis of a flavivirus infection, preferably an infection with YFV or a disorder related to an infection with YFV, or an infection with DENV or a disorder related to an infection with DENV.

Item 76. Method of treating or preventing a disorder, wherein the method comprises administering to a subject in need thereof a therapeutically effective amount of the artificial nucleic acid according to any one of items 1 to 64, the polypeptide according to item 65, the composition according to any one of items 66 to 69, the immunogenic composition according to any one of items 70 to 72, or the kit or kit of parts according to item 73.

Item 77. The method according to item 76, wherein the disorder is a flavirus infection or a disorder related to flavivirus infection, preferably an infection with YFV or a disorder related to an infection with YFV, or an infection with DENV or a disorder related to an infection with DENV.

Further preferred embodiments of the present invention are also defined by the following items 1a to 15a:

1a. Artificial nucleic acid comprising a) at least one coding region encoding at least one polypeptide comprising
   at least one flavivirus protein,
   wherein the flavivirus protein comprises at least one selected from the group consisting of
   a capsid protein (C), a premembrane protein (prM), a membrane protein (M), an envelope protein (E) and a non-structural protein,
   or a fragment or variant of any one of these proteins, and b) an untranslated region (UTR) comprising at least one heterologous UTR element,
   wherein the flavivirus protein is derived from yellow fever virus or from dengue virus.

2a. The artificial nucleic acid according to item 1a, wherein the at least one encoded polypeptide comprises a flavivirus envelope protein (E), a flavivirus premembrane protein (prM) and/or a flavivirus membrane protein (M), or a fragment or variant of any one of these proteins.

3a. The artificial nucleic acid according to item 1a or 2a, wherein the artificial nucleic acid further comprises a heterologous nucleic acid sequence.

4a. The artificial nucleic acid according to any one of items 1a to 3a, wherein the at least one encoded polypeptide comprises at least one signal sequence, preferably a heterologous signal sequence, or a fragment or variant thereof, wherein the at least one signal sequence is preferably a signal sequence of a secretory protein or a signal sequence of a membrane protein, or a fragment or variant thereof, more preferably wherein the signal sequence is derived from a flavivirus protein, even more preferably from a Japanese Encephalitis virus (JEV) protein, a yellow fever virus protein or from a dengue virus protein, or from a fragment or variant thereof.

5a. The artificial nucleic acid according to any one of items 1a to 4a, wherein the at least one encoded polypeptide comprises at least one amino acid sequence, which promotes virus-like particle (VLP) formation, wherein the amino acid sequence promoting virus-like particle (VLP) formation is preferably derived from hepatitis B virus core antigen, more preferably from Woodchuck hepatitis B virus core antigen (WHbcAg).

6a. The artificial nucleic acid according to any one of items 1a to 5a, wherein the at least one encoded polypeptide comprises at least one amino acid sequence, which promotes antigen clustering and/or formation of nanoparticles, wherein the amino acid sequence promoting antigen clustering and/or formation of nanoparticles is preferably derived from ferritin, more preferably from *Helicobacter pylori* ferritin, even more preferably from *Helicobacter pylori* J99 ferritin.

7a. The artificial nucleic acid according to any one of items 1a to 6a, wherein the at least one encoded polypeptide comprises at least one amino acid sequence, which promotes self-cleavage of the encoded polypeptide, wherein the amino acid sequence promoting self-cleavage of the encoded polypeptide is preferably derived from the 2A peptide from foot-and-mouth disease virus.

8a. The artificial nucleic acid according to any one of items 1a to 7a, wherein the at least one encoded polypeptide comprises a flavivirus protein, or a fragment or variant thereof, wherein the amino acid sequence of the flavivirus protein is preferably modified with respect to the wildtype amino acid sequence it is derived from, more preferably a modified yellow fever virus protein or a modified dengue virus protein, or a fragment or variant thereof, even more preferably a modified yellow fever virus protein or a modified dengue virus protein having at least one mutated furin cleavage site.

9a. The artificial nucleic acid according to any one of items 1a to 8a, wherein the at least one encoded polypeptide comprises a flavivirus protein, preferably a flavivirus envelope protein, preferably a yellow fever virus envelope protein or a dengue virus envelope protein, or a fragment or variant thereof, comprising at least one mutation that stabilizes the monomeric or the dimeric conformation of the flavivirus protein, or the fragment or variant thereof.

10a. The artificial nucleic acid according to any one of items 1a to 9a, wherein the artificial nucleic acid is an RNA, preferably an mRNA, which more preferably comprises at least one selected from the group consisting of a histone stem-loop, a 3'-UTR element, a 5'-UTR element, a poly(A) sequence and a poly(C) sequence, wherein the histone stem-loop, the 3'-UTR element, the 5'-UTR element, the poly(A) sequence or the poly(C) sequence is preferably heterologous.

11a. The artificial nucleic acid sequence according to any one of items 1a to 10a, wherein the coding region comprises a modified nucleic acid sequence, and wherein the coding region preferably comprises a nucleic acid sequence according to any one of SEQ ID NO: 57-374, 587-954, 1116-1259, 1268-1411, 1424-1567, 1576-1719, 1728-1871, 1880-2023, 2032-2175, 2184-2327, 2336-2479, 5274-26345, 26347-26355, 1107-1115, 1260-1267, 1416-1423, 1568-1575, 1720-1727, 1872-1879, 2024-2031, 2176-2183, 2328-2335, more preferably according to any one of SEQ ID NO: 89-374, 633-954, 1268-1411, 1424-1567, 1576-1719, 1728-1871, 1880-2023, 2032-2175, 2184-2327, 2336-2479, 7908-

26345, 26348-26355, 1260-1267, 1416-1423, 1568-1575, 1720-1727, 1872-1879, 2024-2031, 2176-2183, 2328-2335, or a fragment or variant of any one of these nucleic acid sequences, even more preferably, wherein the artificial nucleic acid comprises a nucleic acid sequence according to any one of SEQ ID NO: 375-458, 2480-2559, 26356, or a nucleic acid sequence according to any one of SEQ ID NO: 459-540, 2560-2639, 26357, or a fragment or variant of any one of these nucleic acid sequences.

12a. Polypeptide encoded by the artificial nucleic acid according to any one of items 1a to 11a.

13a. Composition, preferably an immunogenic composition, comprising at least one artificial nucleic acid as defined by any one of items 1a to 11a, wherein the at least one artificial nucleic acid is complexed or associated with a cationic or polycationic compound and/or a polymeric carrier, or the polypeptide according to item 12a, wherein the composition optionally further comprises a pharmaceutically acceptable carrier and/or an adjuvant.

14a. Kit or kit of parts comprising the artificial nucleic acid according to any one of items 1a to 11a, the polypeptide according to item 12a, the composition according to item 13a, optionally a liquid vehicle for solubilising, and optionally technical instructions providing information on administration and dosage of the components.

15a. The artificial nucleic acid according to any one of items 1a to 11a, the polypeptide according to item 12a, the composition according to item 13a, or the kit or kit of parts according to item 14a for use as a medicament, preferably for use in the treatment or prophylaxis of a flavivirus infection, more preferably an infection with yellow fever virus or a disorder related to an infection with yellow fever virus, or an infection with dengue virus or a disorder related to an infection with dengue virus.

BRIEF DESCRIPTION OF THE DRAWINGS

FIG. 2: Schematic diagram of Yellow Fever constructs. The figure shows non-limiting exemplary schematic overviews of YFV constructs of the invention. Abbreviations as described in the specifications.

Figure 1:
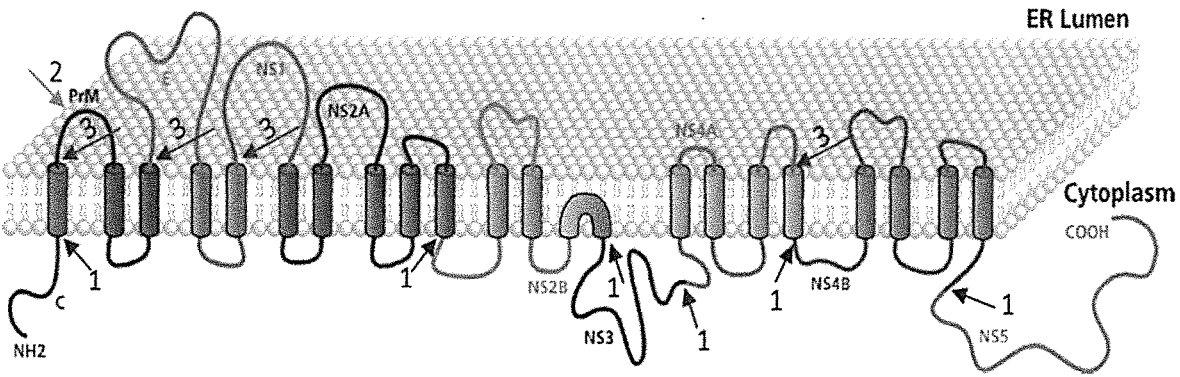
FIG. 1: shows the membrane topology of the flavivirus structural proteins. Cleavage sites indicated: (1) viral serine-protease cleavage site (NS3/2B); (2) host signalase cleavage site; (3) furin cleavage site. Abbreviations: prM: premembrane protein; NS: non-structural protein; E: envelope protein; ER: endoplasmic reticulum. Figure adapted from Umareddy et al., Virol J 4.1 (2007):91.

FIG. 5: Vaccination of mice with YF constructs and detection of an antigen-specific humoral response. The figure shows IgG2a and IgG1 titers of mice immunized with formulated YF mRNAs. Antibody titers were measured 4 weeks post third immunization (prime: day 0, boost: day 14, day 28). Constructs R2588, R2608, R2612, R2616, R2582 were used. The horizontal bar indicates the median. For a detailed description, see Example 4.

FIG. 6: Vaccination of mice with YF constructs and detection of an antigen-specific T-cell response (ICS by FACS analysis). The figure shows the induction of antigen-specific CD8+ and CD4+ T cells by yellow fever mRNA in mice. T cell analysis was performed five days after the last immunization (day 26). Cytokine producing T cells were measured by intracellular flow cytometry after stimulation of isolated spleen cells with a mix of four peptides, compared to unstimulated controls. (A and B) Identity of CD8+ T cells was verified by staining of cell surface markers using specific antibodies. Individual frequencies and median of vaccinated and stimulated groups are displayed. (A) IFN-γ positive CD8+ T cells; (B) TNF-α positive CD8+ T cells. (C and D) Identity of CD4+ T cells was verified by staining of cell surface markers using specific antibodies. Individual frequencies and median of vaccinated and stimulated groups are displayed. (C) IFN-γ positive CD4+ T cells; (D) TNF-α positive CD4+ T cells. For a detailed description, see Example 5.

Figure 7:
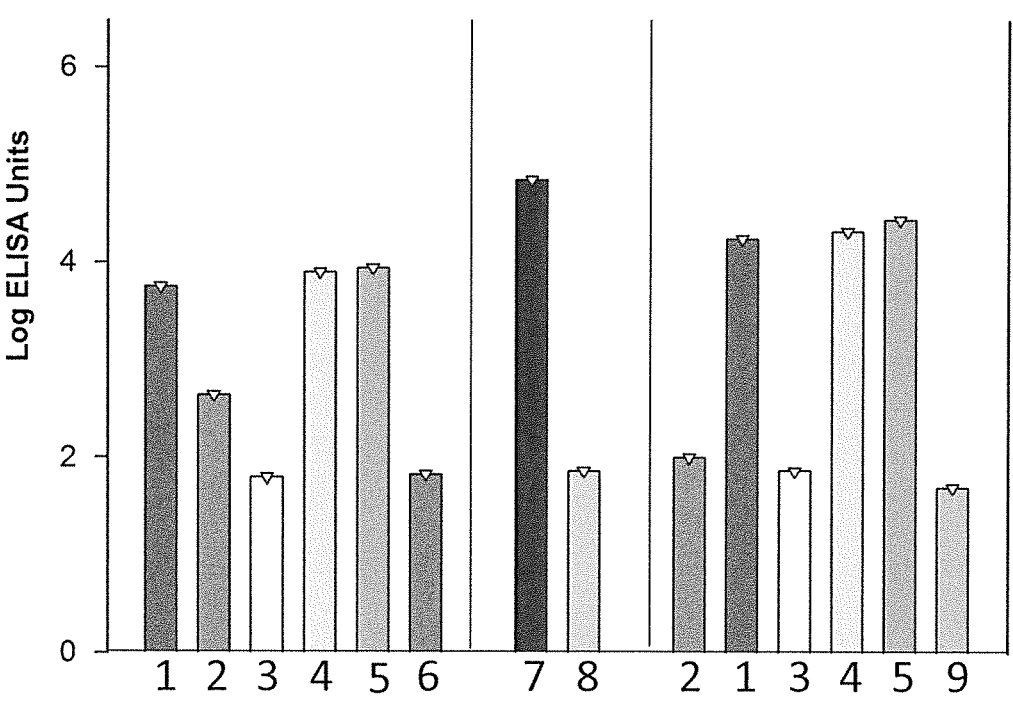

FIG. 7: Vaccination of mice with YF constructs: ELISA IgG anti-inactivated YF cell culture on pooled mouse sera. The figure shows that immunization of mice with formulated mRNA coding for indicated YF proteins leads to the production of antibodies. Inactivated YF virus immunization served as a positive control. 1: R2608; 2: R2588; 3: R2612; 4: R2616; 5: R2582; 6: R2569; 7: Inactivated YF virus+ALOOH; 8: buffer+ALOOH; 9: Ringer lactate buffer. For a detailed description, see Example 6.

Figure 8:
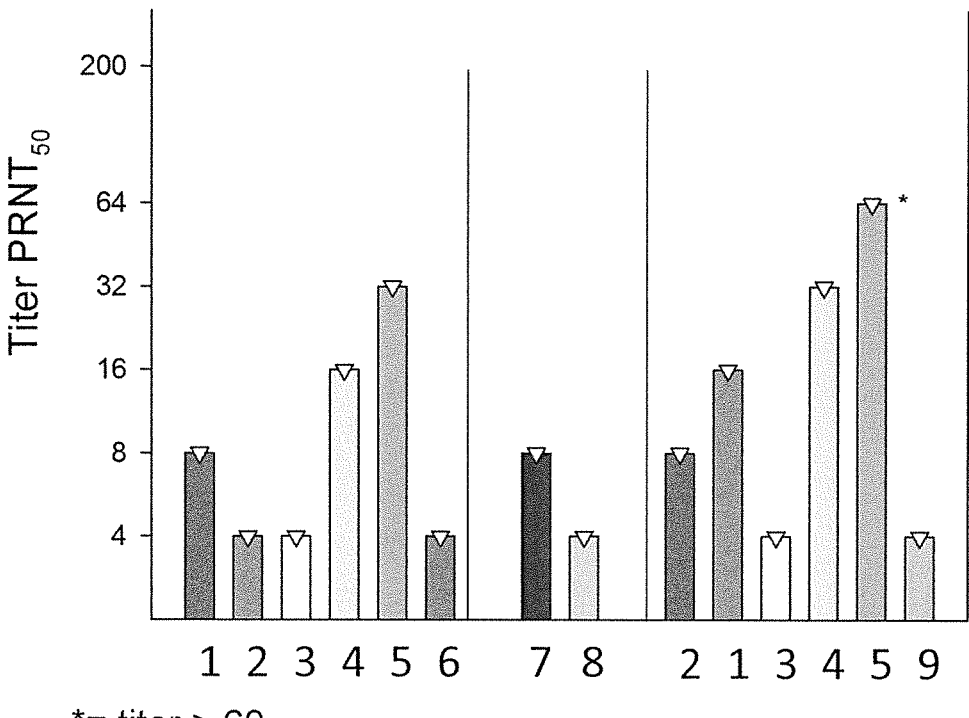

FIG. 8: Vaccination of mice with YF constructs: plaque reduction neutralization test (PRNT). The figure shows that immunization of mice with mRNAs coding for indicated YF proteins leads to the production of functional antibodies. Plaque reduction neutralization tests (PRNT50) were performed according to Example 7. Inactivated YF virus immunization served as a positive control. 1: R2608; 2: R2588; 3: R2612; 4: R2616; 5: R2582; 6: R2569 (luciferase, control); 7: Inactivated YF virus+ALOOH; 8: buffer+ALOOH; 9: Ringer lactate buffer. For a detailed description, see Example 7.

Figure 9:
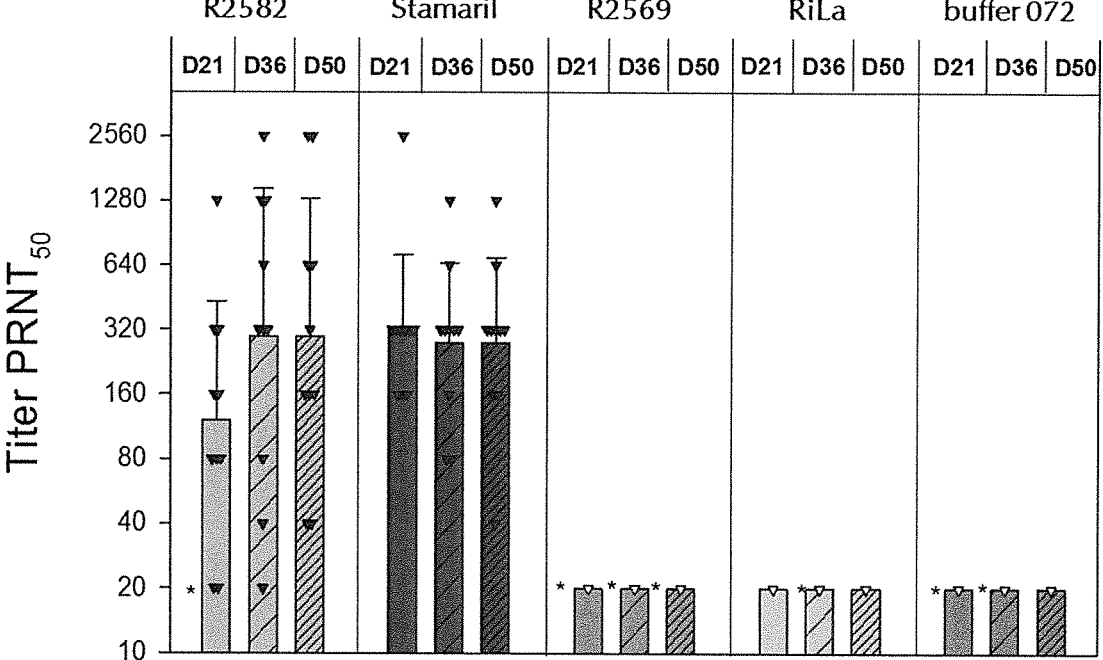

FIG. 9: Vaccination of hamsters with YF prME constructs and plaque reduction neutralization test (PRNT); Neutralizing antibody titers induced in hamsters. The figure shows that immunization of hamsters with formulated RNA R2582 induces neutralizing antibody titers comparable to the YF vaccine Stamaril®. Even one dose of R2582 induces a high level of neutralizing antibodies on day 21, which is further increased by the second and third doses as measured on days 36 and 50. The R2582-induced antibody titer is comparable to the titer achieved with one dose of Stamaril® administered on day 0. Plaque reduction neutralization tests (PRNT50) were performed according to Example 7. The YFV vaccine Stamaril® served as a positive control. Luciferase-encoding R2569 served as a negative control. The buffers for RNA (Ringer Lactate) and Stamaril® (buffer 072) served as controls. For a detailed description, see Example 8. Asterisks: titers >20. Black rectangles: pooled sera; white rectangles: individual sera.

FIG. 10: Vaccination of non-human primates with YF constructs: antibody detection and virus neutralization assay. The figure shows that immunization of non-human primates (NHP) with formulated RNA R2582 encoding the prME protein induces neutralizing antibodies titers comparable to the YF vaccine Stamaril®. Plaque reduction neutralization tests (PRNT50) were performed according to Example 7. The YFV vaccine Stamaril® served as a positive control. (A) ELISA results; (B) PRNT50 results. For a detailed description, see Example 9.

FIG. 11: Schematic diagram of Dengue virus (DENV) constructs. The figure shows non-limiting exemplary schematic diagrams of designed DENV constructs. Abbreviations as described in the specifications.

Figure 12:
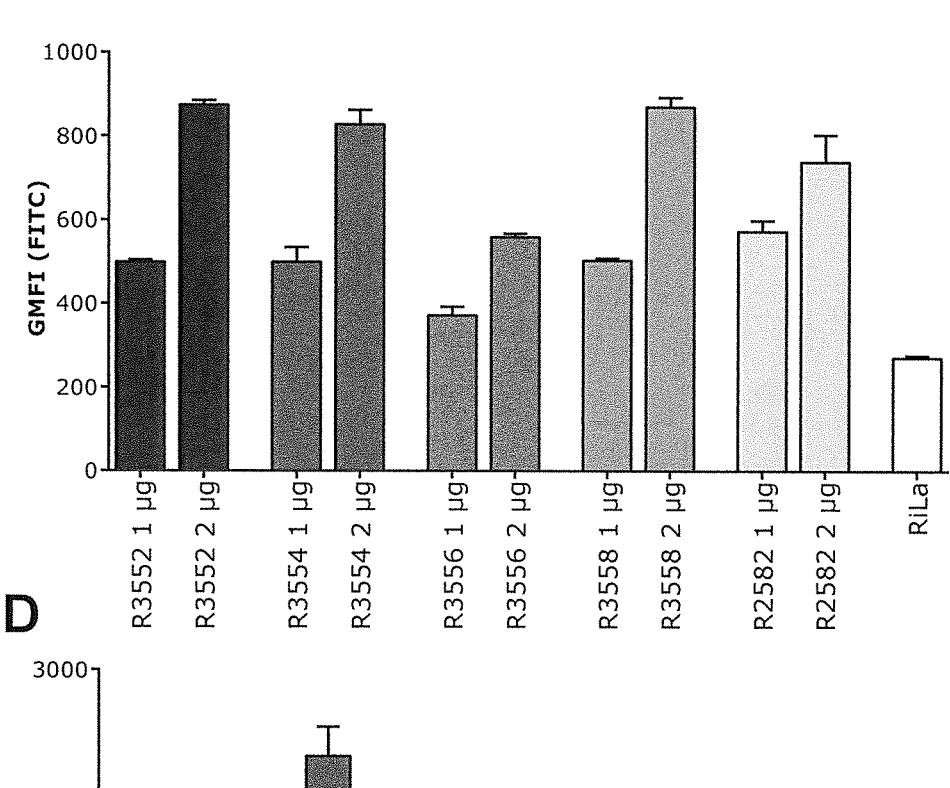

FIG. 12: In vitro characterization of DENV protein expression in HeLa cells by western blot and FACS. The figure shows that transfection of HeLa cells with mRNAs coding for DENV proteins leads to the expression of the encoded DENV E proteins. Analysis performed by intracellular FACS using the pan-flaviviral anti-E protein 4G2. (A) DENV-1 constructs; (B) DENV-2 constructs; (C) DENV-3 constructs; (D) DENV-4 constructs. mRNA constructs used for transfection are indicated in the figure. YF prME mRNA (R2582) served as a positive control. Ringer lactate buffer served as a negative control. For a detailed description, see Example 11.

Figure 13:
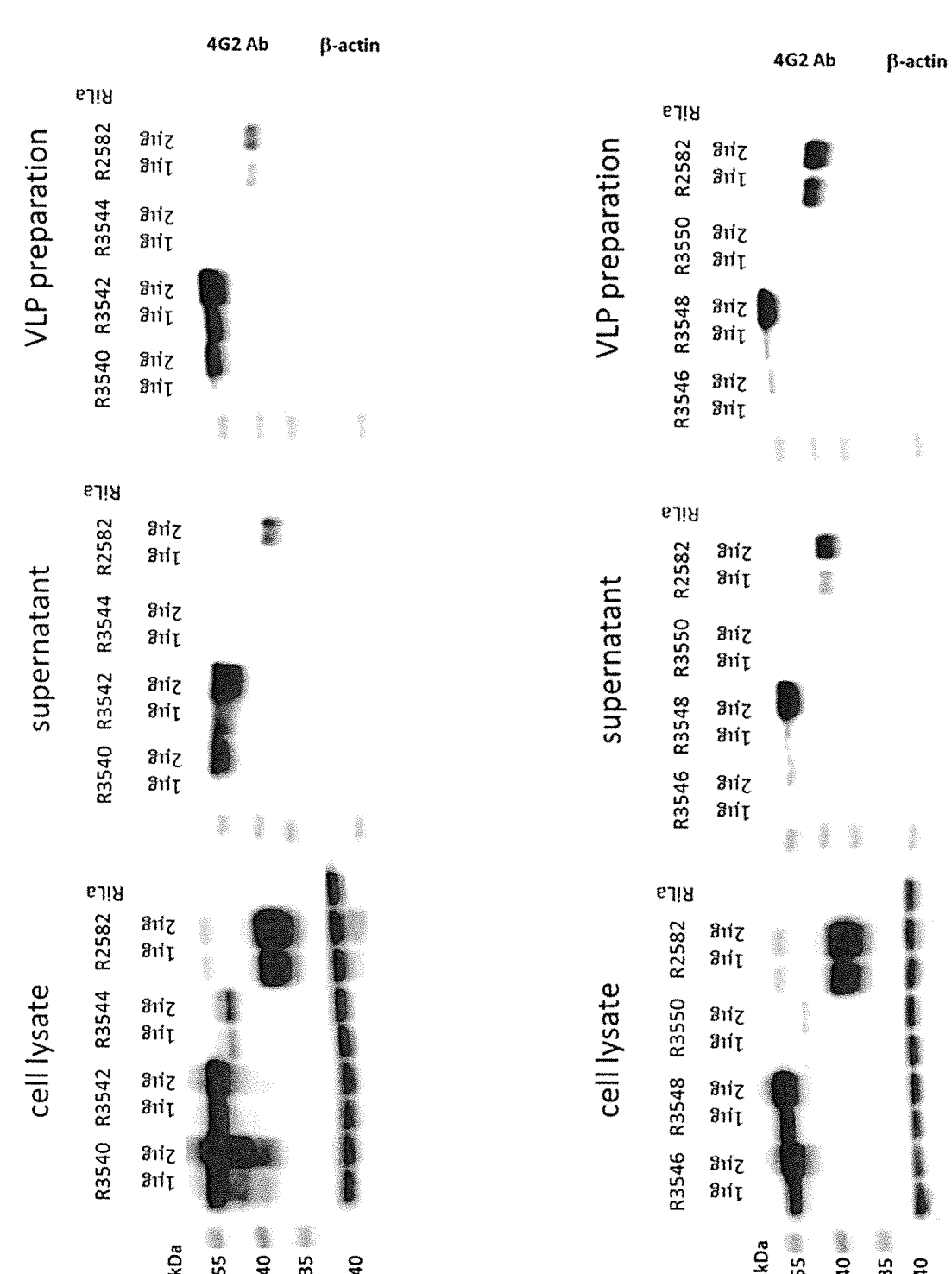

FIG. 13: Expression and secretion of DENV-1, DENV-2, DENV-3 and DENV-4 proteins (Western blot). The figure shows a western blot to detect E proteins in cell lysate, tissue culture supernatant and VLP preparations using the pan-flaviviral anti-E protein antibody 4G2. (A) DENV-1 constructs; (B) DENV-2 constructs; (C) DENV-3 constructs; (D) DENV-4 constructs. For a detailed description, see Example 11.

FIG. 14: Summary of the in vitro characterization of DENV 1-4 mRNA constructs. The figure shows a summary of the performed in vitro characterization of the indicated DENV mRNA constructs. Shown are the results of the intracellular FACS analysis (cf. FIG. 12) and the results of the western blot performed on cell lysates, supernatants and virus-like-particle (VLP) preparations using 4G2 antibody (cf. FIG. 13). The results were assessed quantitatively, as displayed in the figure (+++=strong signal; ++=medium signal; +=weak signal; −=no signal). For a detailed description, see Example 11.

Figure 15:
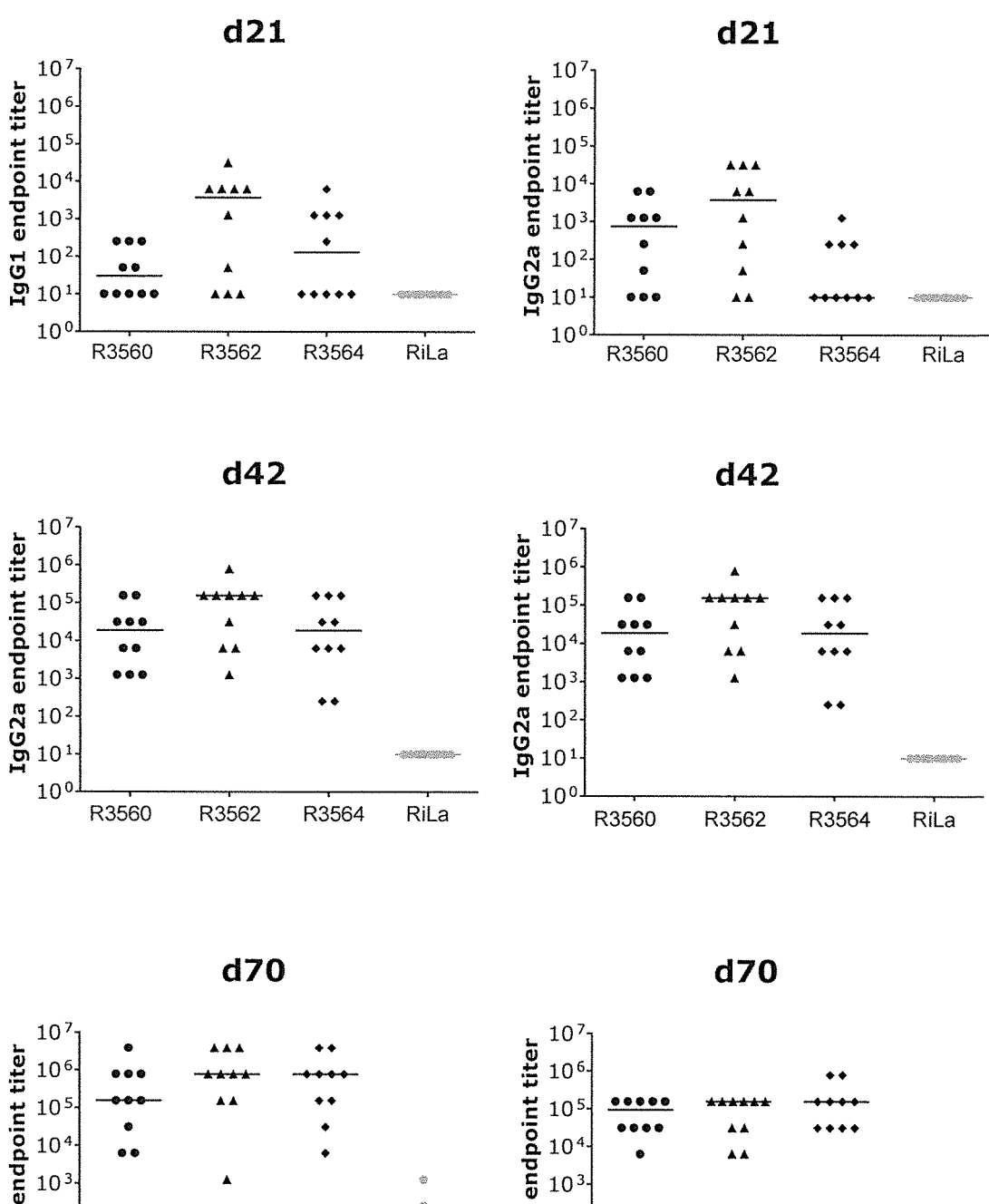

FIG. 15: shows IgG1 (left panels) and IgG2a titers (right panels) of mice immunized with 40 μg formulated mRNAs encoding the respective DENV antigens (prime: day 0, boost: day 21, day 42). DENV specific antibody endpoint titers were determined on days 21, 42 and 56 (day 70 for DENV-4) post prime immunization. As a control, mice were injected with ringer lactate buffer (RiLa). (A) Vaccination of mice with DENV constructs and detection of an antigen-specific humoral response. DENV-1 constructs: R3540, R3542 and R3544; (B) Vaccination of mice with DENV constructs and detection of an antigen-specific humoral response. DENV-2 constructs: R3546, R3548 and R3550; (C) Vaccination of mice with DENV constructs and detection of an antigen-specific humoral response. DENV-3 constructs: R3552, R3554, R3556 and R3558; (D) Vaccination of mice with DENV constructs and detection of an antigen-specific humoral response. DENV-4 constructs: R3560, R3562 and R3564. The horizontal bar indicates the median. For a detailed description, see Example 12.

FIG. 16: In vitro characterization of DENV 1-constructs in HeLa cells by western blot and FACS: The figure shows in vitro expression analysis of DENV-1 and DENV-2 C-P2A-SSC-prME mRNA constructs using an anti-E protein specific antibody (4G2). (A) Shows a western blot of whole cell lysates (4G2); (B) shows the results of the FACS analysis. For a detailed description, see Example 13.

Figure 17:
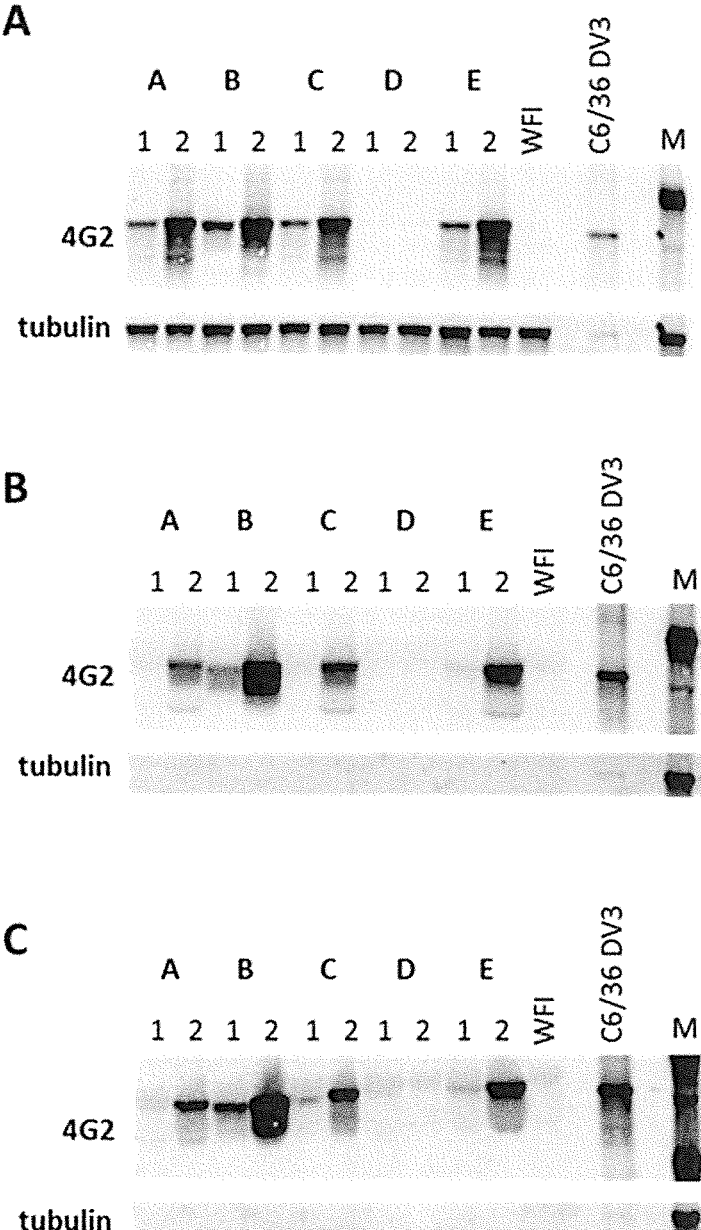

FIG. 17: Expression of DENV3 E-protein mutant in HeLa cells and mice. The figure shows in vitro expression analysis of DENV-3 E protein mutant constructs. HeLa cells were transfected with 1 μg or 2 μg of formulated mRNA R3552 (sample A), R3554 (sample B), R3558 (sample C), R3765 (sample D), R3780 (sample E). Cell lysates (A) supernatants (B) and VLP preparations (C) were analyzed via western blot using an anti-E protein specific antibody (4G2). (D) Whole cell lysates were subjected to non-reducing/non-denaturing SDS-PAGE (10% gel) followed by western blot detection using mouse sera collected two weeks post third immunization of mice with DENV-3 prME formulated mRNA. For a detailed description, see Example 14.

Figure 18:
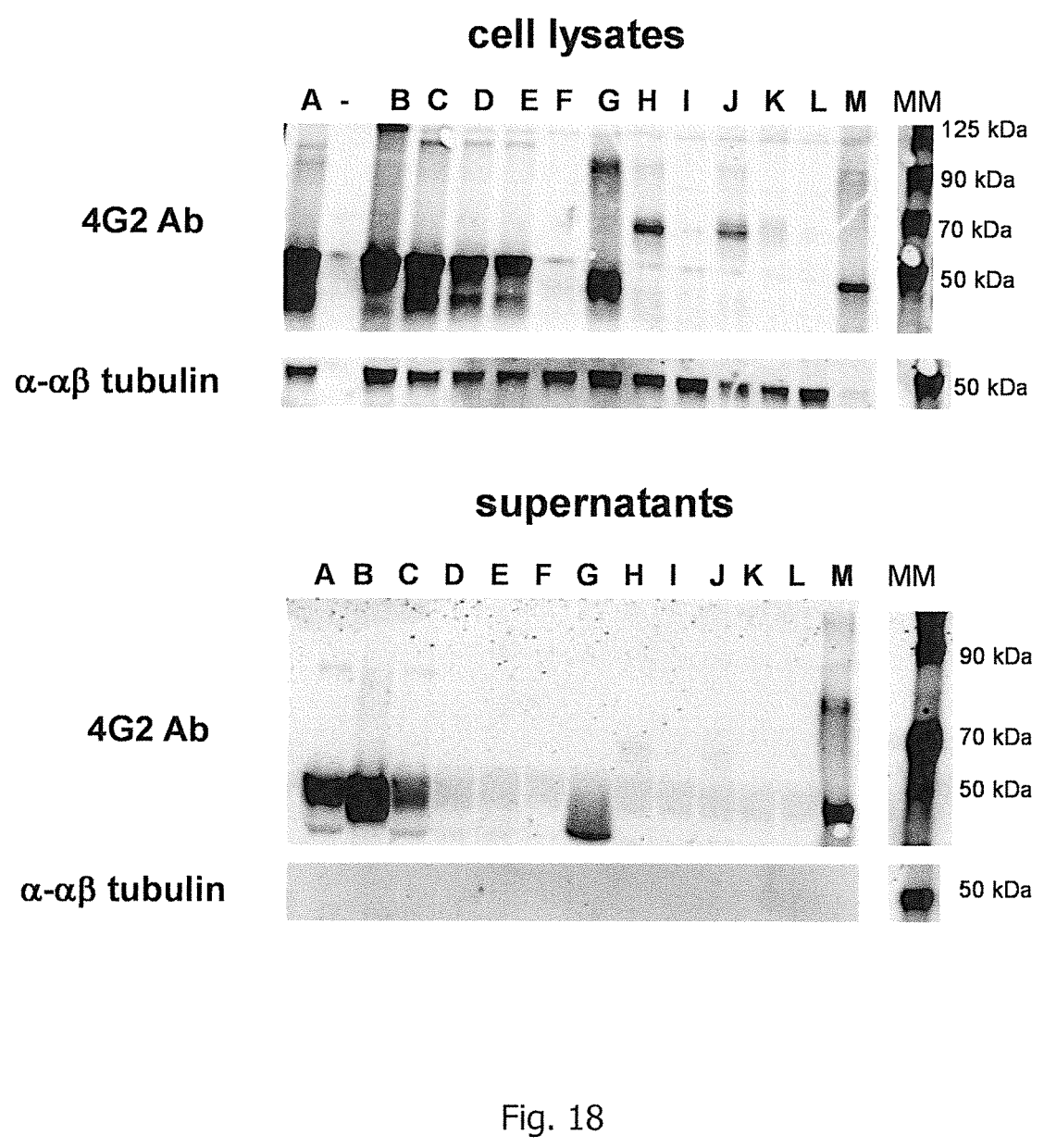

FIG. 18: In vitro characterization of DENV3 constructs expression in HeLa cells by western blot. The figure shows in vitro expression analysis of different DENV-3 constructs. HeLa cells were transfected with the respective amount of formulated mRNA encoding DENV-3. Sample A, R3552; Sample B, R3554; Sample C, R3790; Sample D, R3792; Sample E, R3794; Sample F, R3804; Sample G, R3556; Sample H, R3796; Sample I, R3798; Sample J, R3800; Sample K, R3802; WFI (sample L), C6/36 VDV3 lysate (sample M) and analyzed via western blot using an anti-E protein specific antibody (4G2). For a detailed description, see Example 15.

FIG. 19: shows humoral immune responses induced upon i.d. immunization of mice with E protein mutant RNA constructs. Mice were immunized i.d. with 40 μg of the respective formulated RNA constructs R3552, R3558, R3765, R3780 administered in a prime/boost/boost regimen on day 0, 21 and 42. RiLa buffer treated mice were used as control. DENV-3 serotype-specific E protein specific IgG1 and IgG2a titers were determined on day 21 (A), 42 (B), 49 (C) by ELISA using UV inactivated CYD3 virus for coating. The horizontal bar indicates the median. Statistical analysis was performed with Graph Pad Prism Software using Kruskal Wallis with Dunn's multiple comparison tests to determine statistical significance. P-value indicators *, *, ** refer to $p < 0.05$, $p < 0.01$ and $p < 0.0001$, respectively. For a detailed description, see Example 16.

Figure 20:
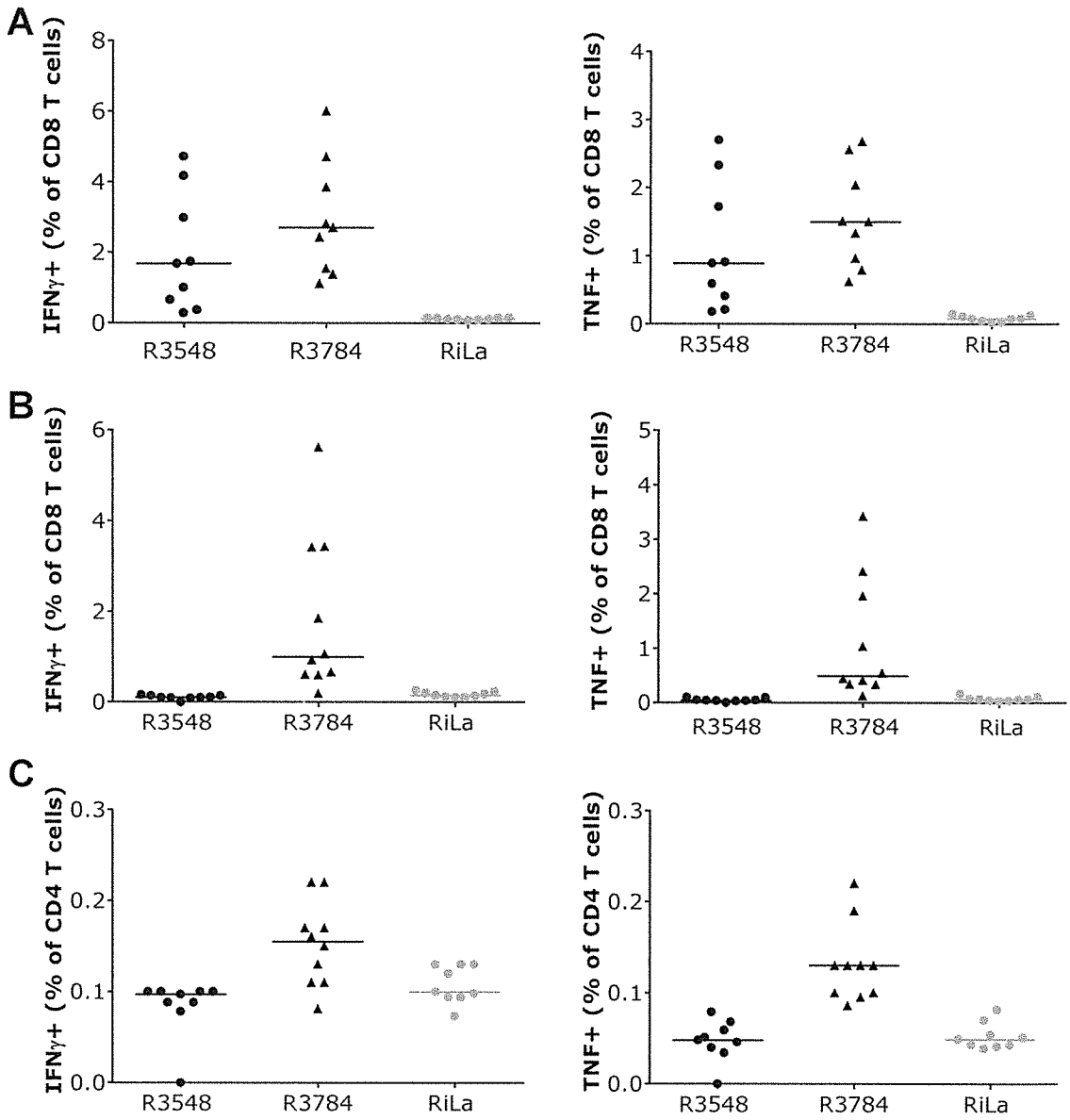

FIG. 20: shows cellular immune responses to the E and C protein induced upon i.d. immunization with DENV-2 constructs in mice immunized i.d. with 40 μg of the respective formulated RNA constructs R3548 and R3784 in a prime/boost/boost regimen on day 0, 21 and 42. RiLa buffer treated mice were used as ctrl. T cell immune responses were measured by ICS upon re-stimulation of splenocytes (isolated on day 49 post prime) with a DENV-3 E protein or C protein specific peptide mix. (A) E protein specific CD8+ T cell responses (B)C-protein specific CD8+ T cell responses and (C)C-protein specific CD4+ T cell responses. The horizontal bar indicates the median. For a detailed description, see Example 17.

Figure 21:
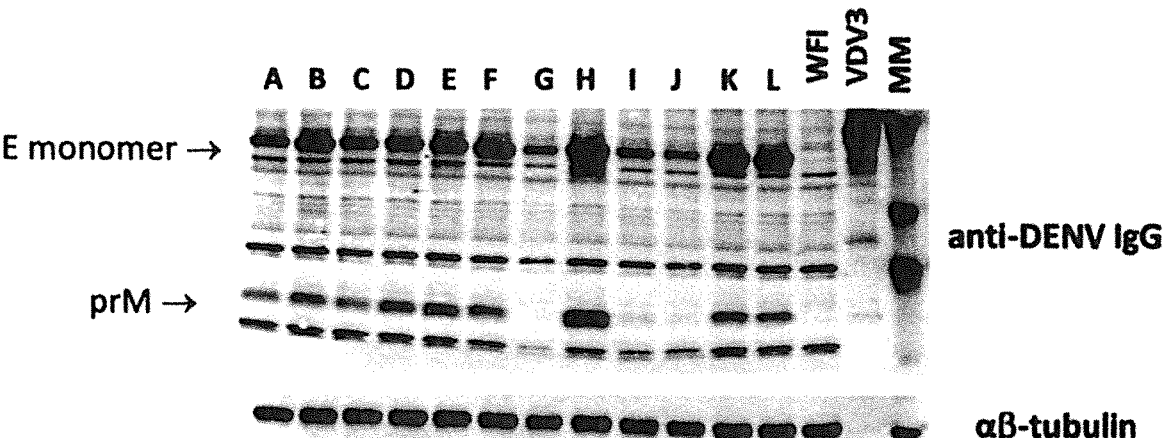

FIG. 21: Western blot expression analysis (whole cell lysates) of the DENV-3 furin cleavage mutants. For a detailed description, see Example 18.

FIG. 22: Normalized signal intensities (obtained with anti-DENV IgG; c.f. FIG. 21) of the E protein (panel A) and prM signal (panel B). E/prM ratio is shown in panel C. For a detailed description, see Example 18.

FIG. 23: Western blot expression analysis of the DENV-3 furin cleavage mutants. Whole cell lysates, cell free supernatants and VLP preparations using 4G2 Antibody. For a detailed description, see Example 18.

Figure 24:
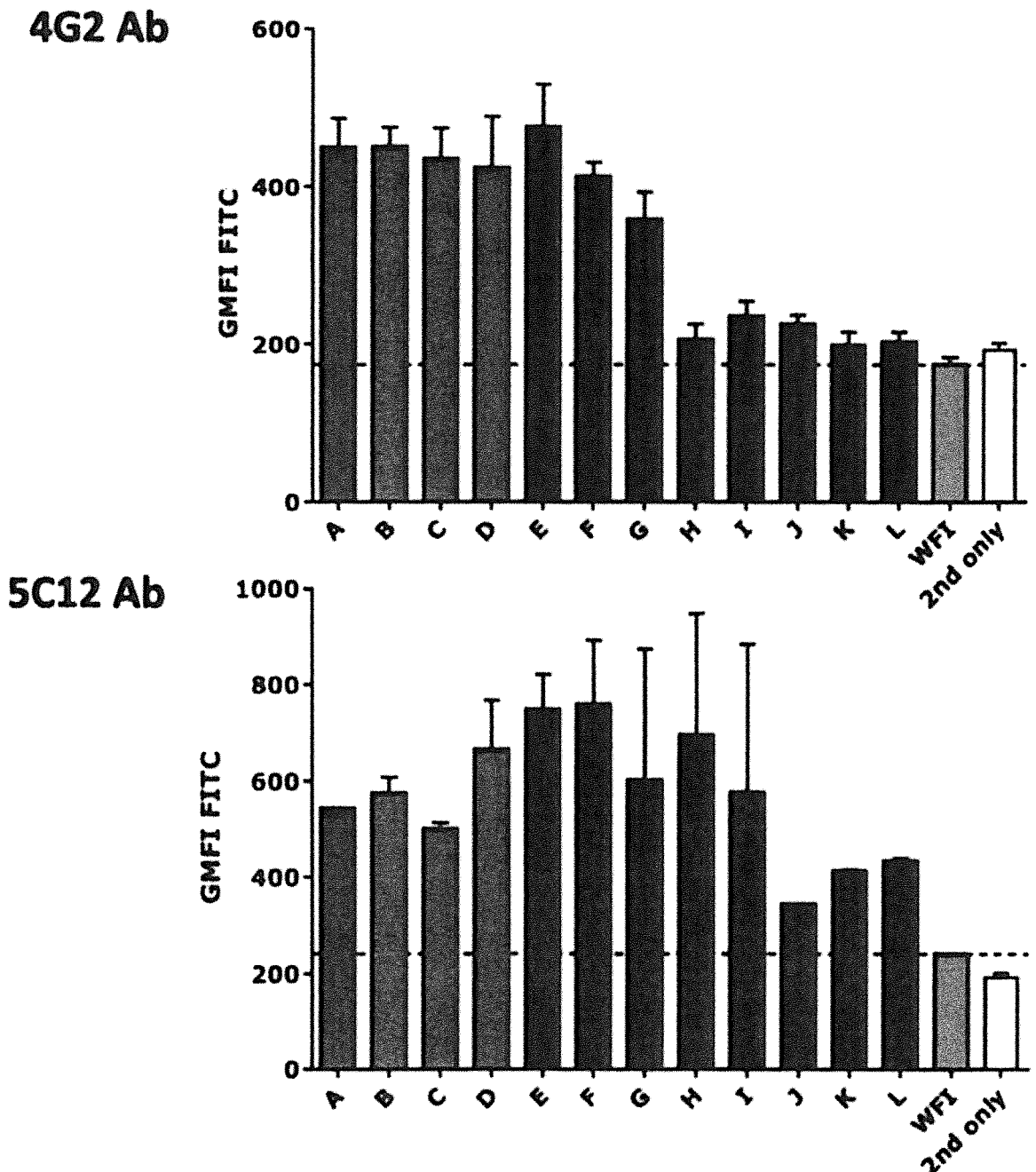

FIG. 24: Analysis of the expression of DENV3 furin cleavage mutants: FACS analysis. Flow cytometric analysis of transfected cells stained intracellularly with 4G2 antibody or 5C12 antibody followed by a secondary anti-mouse FITC-conjugated antibody. For a detailed description, see Example 18.

Figure 25:
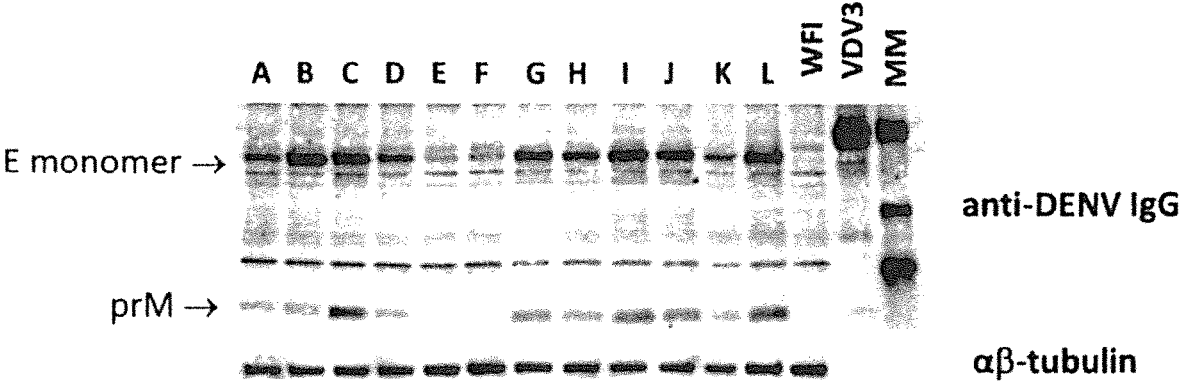

FIG. 25: Western blot expression analysis (whole cell lysates) of the DENV-3 pre-fusion conformation mutants. For a detailed description, see Example 19.

Figure 26:
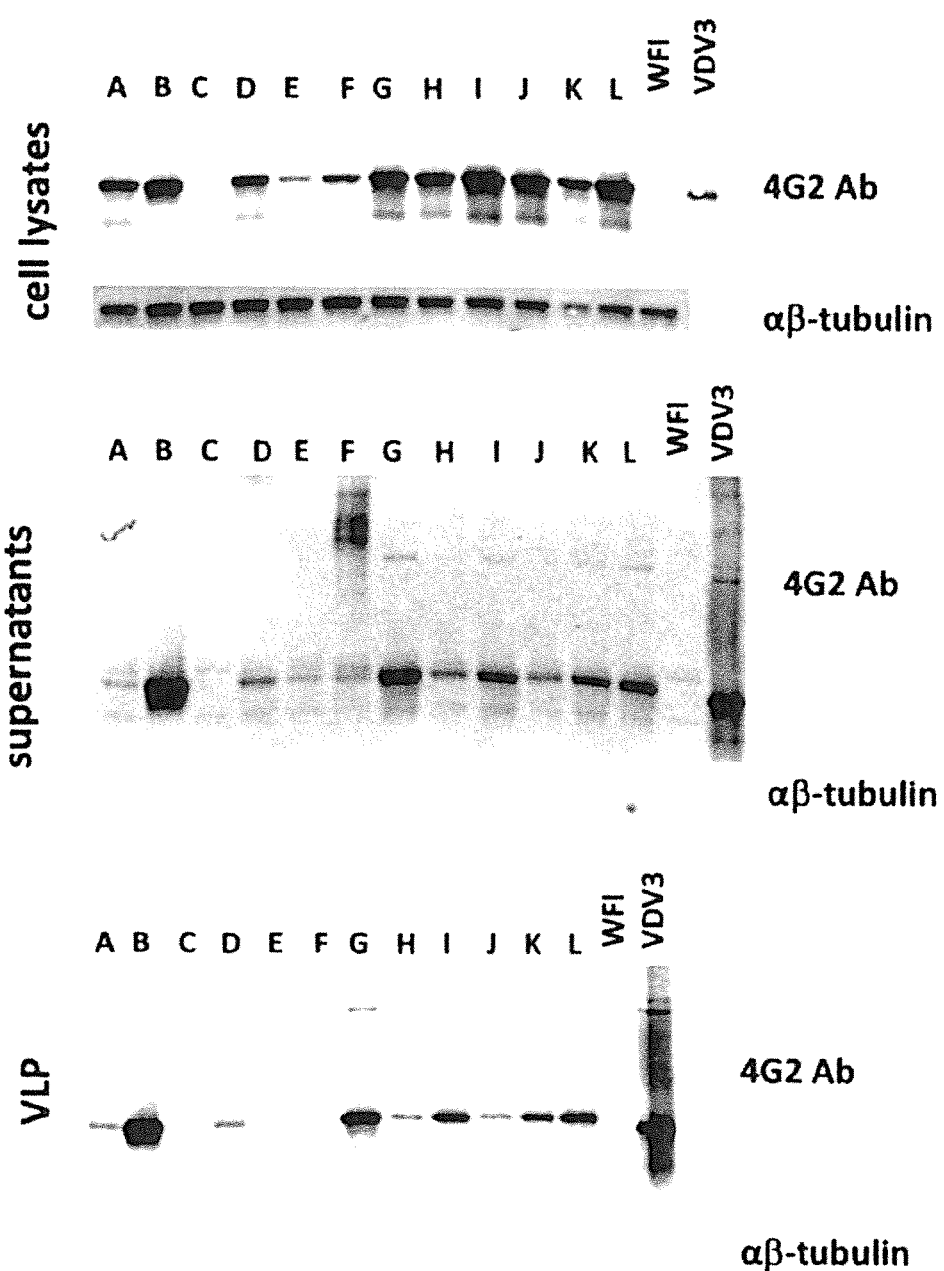

FIG. 26: Western blot expression analysis of the DENV-3 pre-fusion conformation mutants. Whole cell lysates, cell free supernatants and VLP preparations using 4G2 Antibody. For a detailed description, see Example 19.

Figure 27:
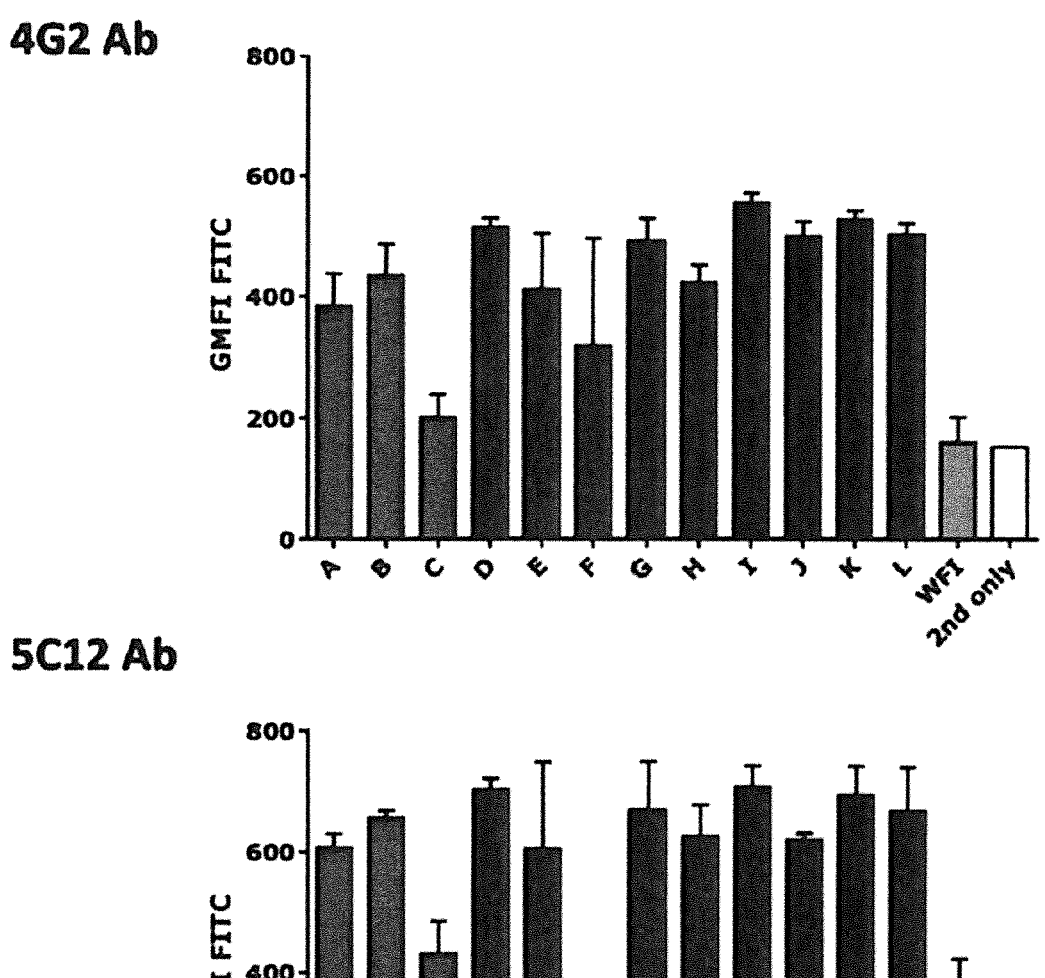

FIG. 27: Analysis of the expression of DENV3 pre-fusion conformation mutants: FACS analysis. Flow cytometric analysis of transfected cells stained intracellularly with 4G2 antibody or 5C12 antibody followed by a secondary anti-mouse FITC-conjugated antibody. For a detailed description, see Example 19.

Figure 28:
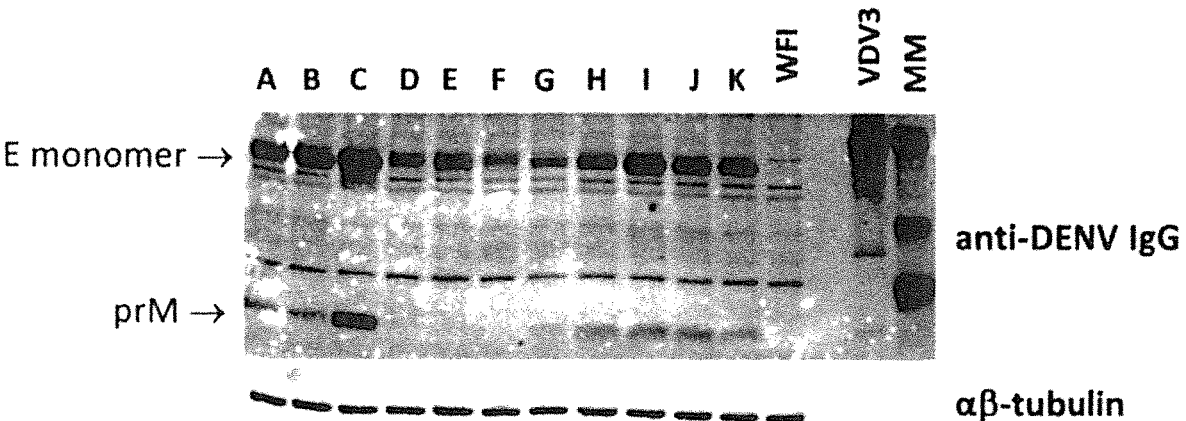

FIG. 28: Western blot expression analysis (whole cell lysates) of the DENV-3 fusion loop deletion and protonable His mutants. Abbreviations (A-K) are explained in Table 2. For a detailed description, see Example 20.

Figure 29:
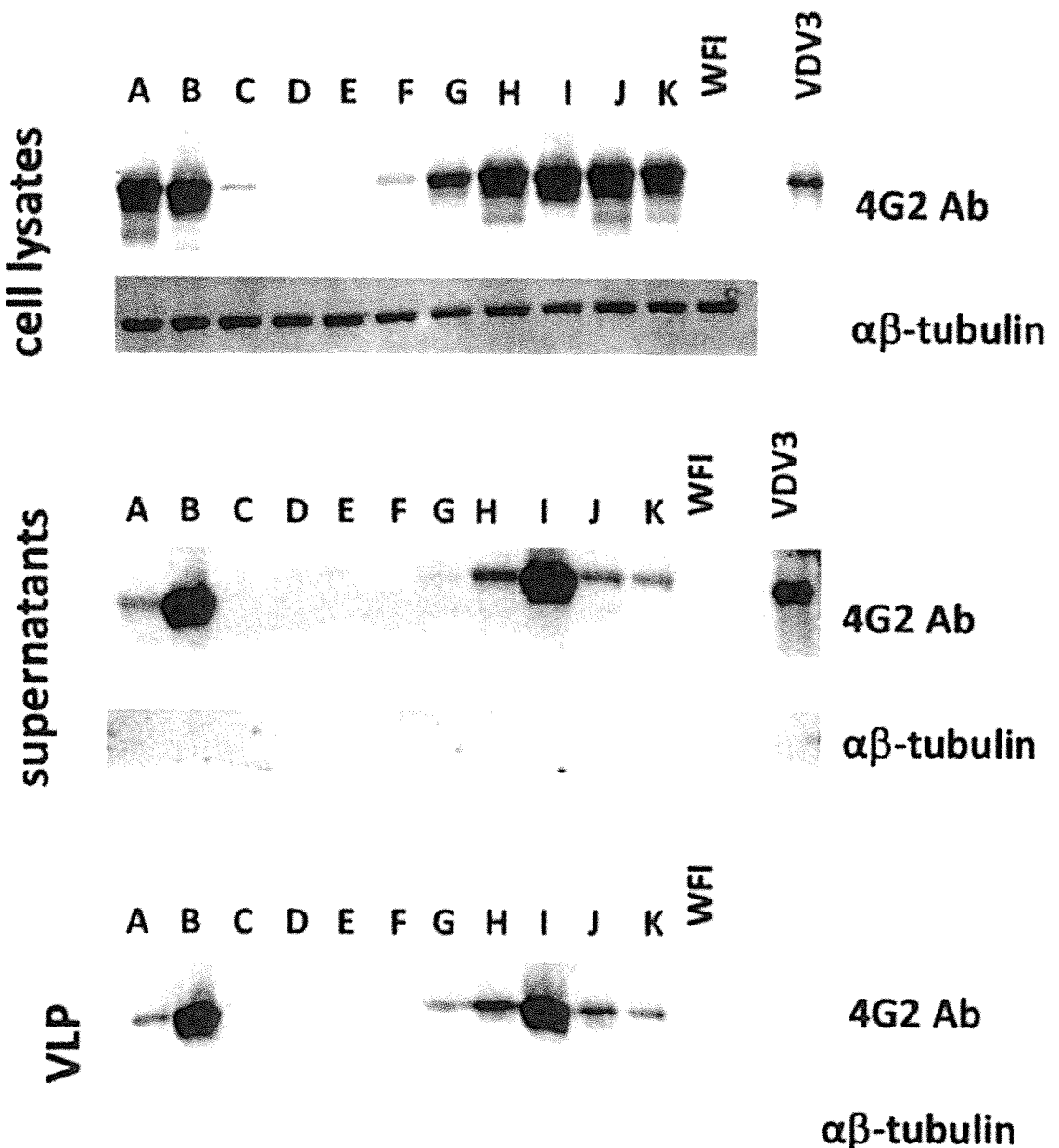

FIG. 29: Western blot expression analysis of the DENV-3 fusion loop deletion and protonable His mutants. Whole cell lysates, cell free supernatants and VLP preparations are shown, analyzed using 4G2 Antibody. Abbreviations (A-K) are explained in Table 13. For a detailed description, see Example 20.

FIG. 30: Analysis of the expression of DENV3 fusion loop deletion and protonable His mutants: FACS analysis. Flow cytometric analysis of transfected cells stained intracellularly with 4G2 antibody or 5C12 antibody followed by a secondary anti-mouse FITC-conjugated antibody. Abbreviations (A-K) are explained in Table 13. For a detailed description, see Example 20.

Figure 31:
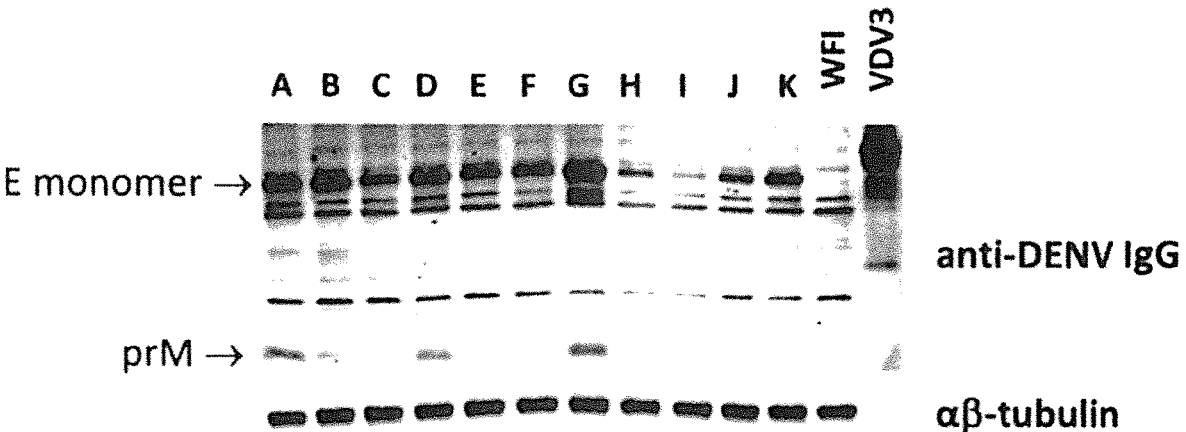

FIG. 31: Western blot expression analysis (whole cell lysates) of the DENV-3 constructs with optimized signal peptide and further pre-fusion stabilization mutants. Abbreviations (A-K) are explained in Table 14. For a detailed description, see Example 21.

Figure 32:
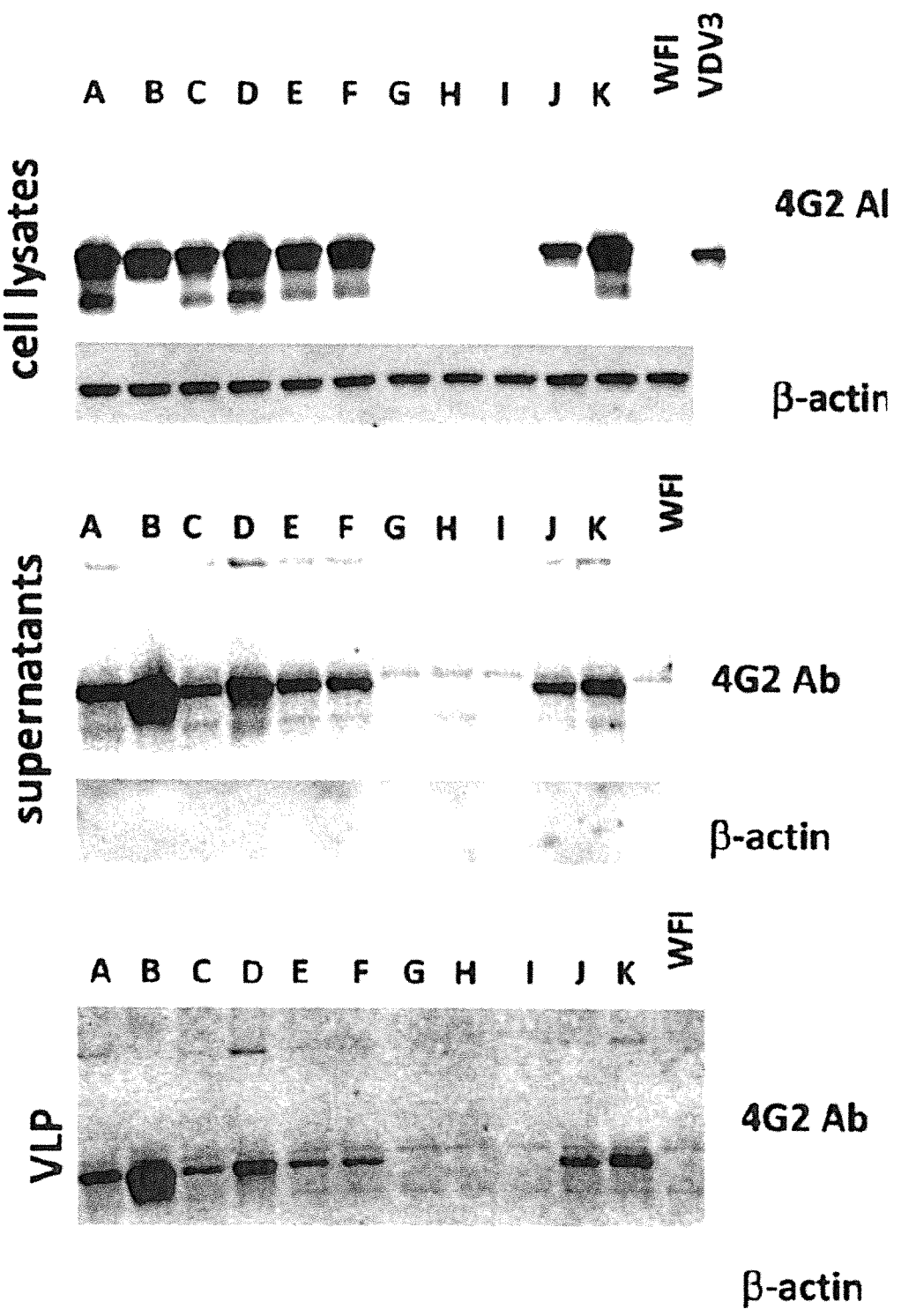

FIG. 32: Western blot expression analysis of the DENV-3 constructs with optimized signal peptide and further pre-fusion stabilization mutants. Whole cell lysates, cell free supernatants and VLP preparations are shown, analyzed using 4G2 Antibody. Abbreviations (A-K) are explained in Table 14. For a detailed description, see Example 21.

FIG. 33: Analysis of the expression of DENV3 constructs with optimized signal peptide and further pre-fusion stabilization mutants: FACS analysis. Flow cytometric analysis of transfected cells stained intracellularly with 4G2 antibody or 5C12 antibody followed by a secondary anti-mouse FITC-conjugated antibody. Abbreviations (A-K) are explained in Table 14. For a detailed description, see Example 21.

FIG. 34: Expression analysis of DENV3 constructs via western blot and FACS. Panel A shows Western blot expression analysis (whole cell lysates) of the DENV-constructs R4454, R4456, and R4464. Panel B shows a flow cytometric analysis of transfected cells stained intracellularly with 5C12 antibody followed by a secondary anti-mouse FITC-conjugated antibody. Abbreviations (J-L) are explained in Table 15. For a detailed description, see Example 22.

Figure 35:
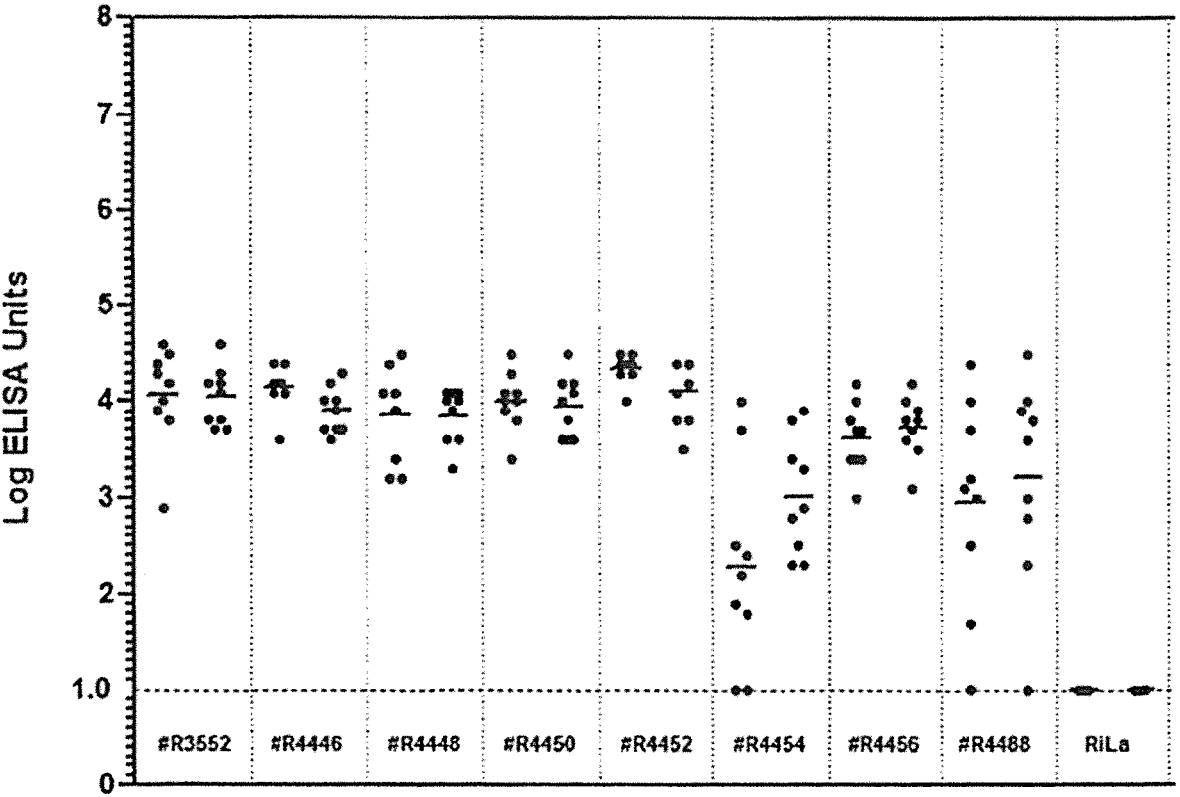

FIG. 35: ELISA analysis of humoral immune response upon vaccination of hamster with DENV3 mRNA constructs. The figure shows that immunization of hamster with formulated mRNA coding for indicated DENV proteins leads to the production of antigen-specific antibodies. Immunization of hamster and subsequent ELISA analysis is described in Example 23. The design of immunization experiment (study 23A) is summarized in Table 16.

Figure 36:
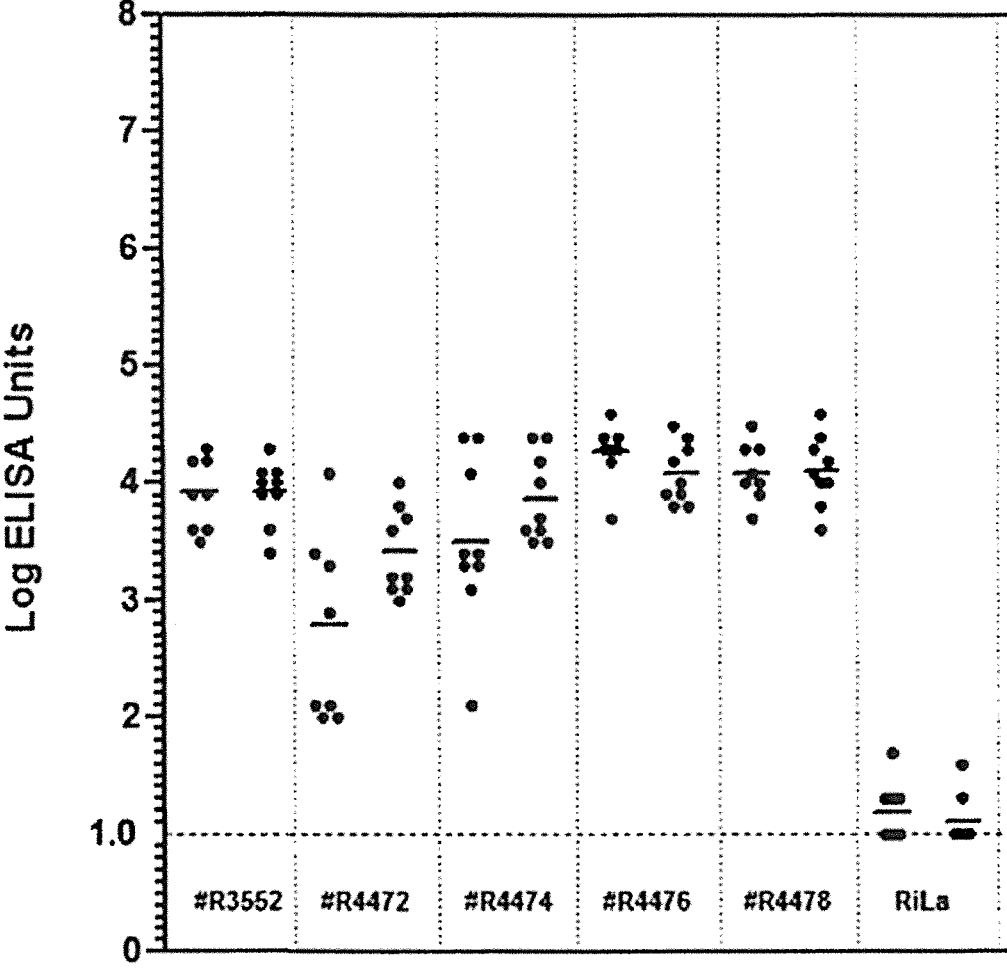

FIG. 36: ELISA analysis of humoral immune response upon vaccination of hamster with DENV3 mRNA constructs. The figure shows that immunization of hamster with formulated mRNA coding for indicated DENV proteins leads to the production of antigen-specific antibodies. Immunization of hamster and subsequent ELISA analysis is described in Example 23. The design of immunization experiment (study 23B) is summarized in Table 17.

Figure 37:
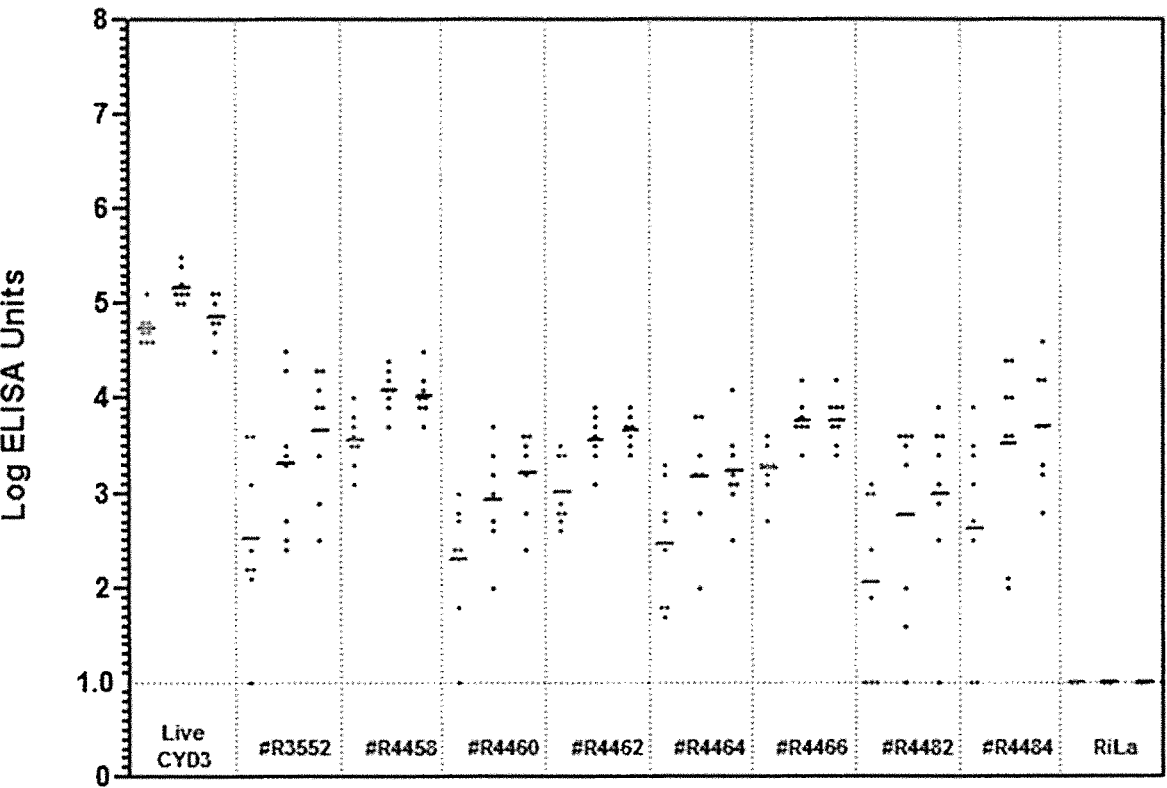

FIG. 37: ELISA analysis of humoral immune response upon vaccination of hamster with DENV3 mRNA constructs. The figure shows that immunization of hamster with formulated mRNA coding for indicated DENV proteins leads to the production of antigen-specific antibodies. Immunization of hamster and subsequent ELISA analysis is described in Example 23. The design of immunization experiment (study 23C) is summarized in Table 18.

Figure 38:
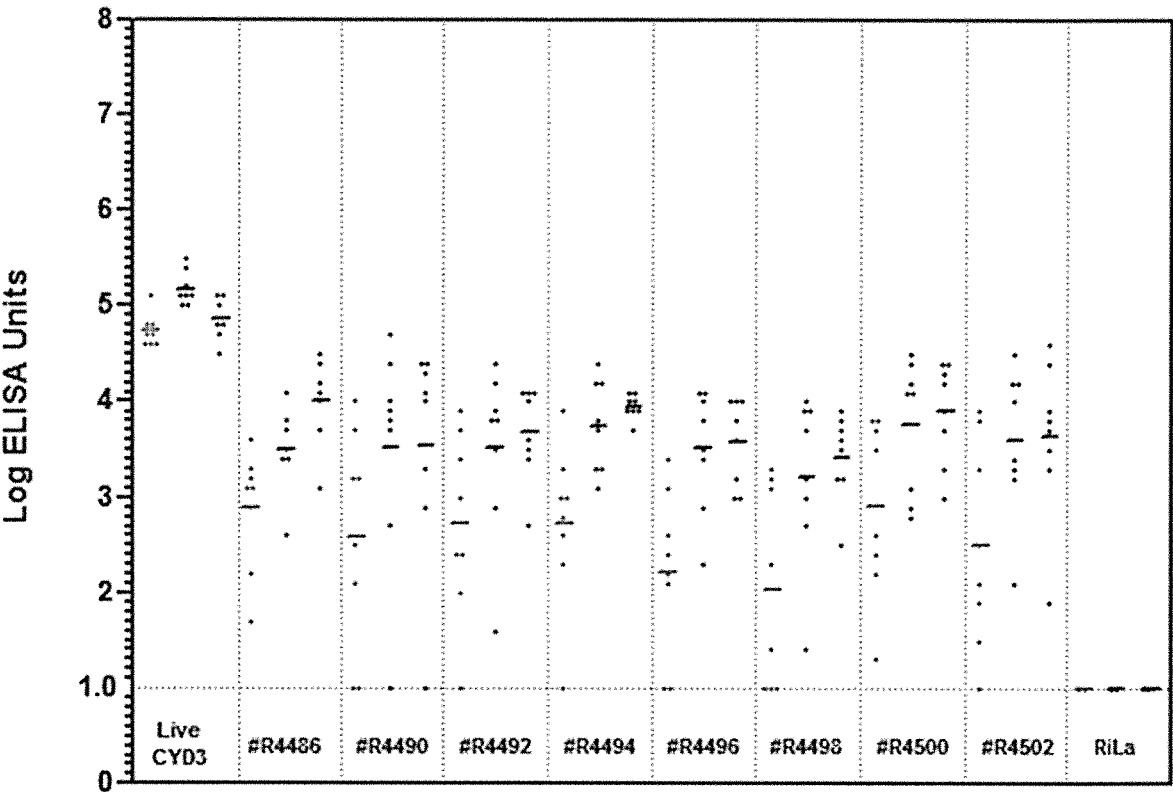

FIG. 38: ELISA analysis of humoral immune response upon vaccination of hamster with DENV3 mRNA constructs. The figure shows that immunization of hamster with formulated mRNA coding for indicated DENV-3 proteins leads to the production of antigen-specific antibodies. Immunization of hamster and subsequent ELISA analysis is described in Example 23. The design of immunization experiment (study 23C) is summarized in Table 18.

Figure 39:
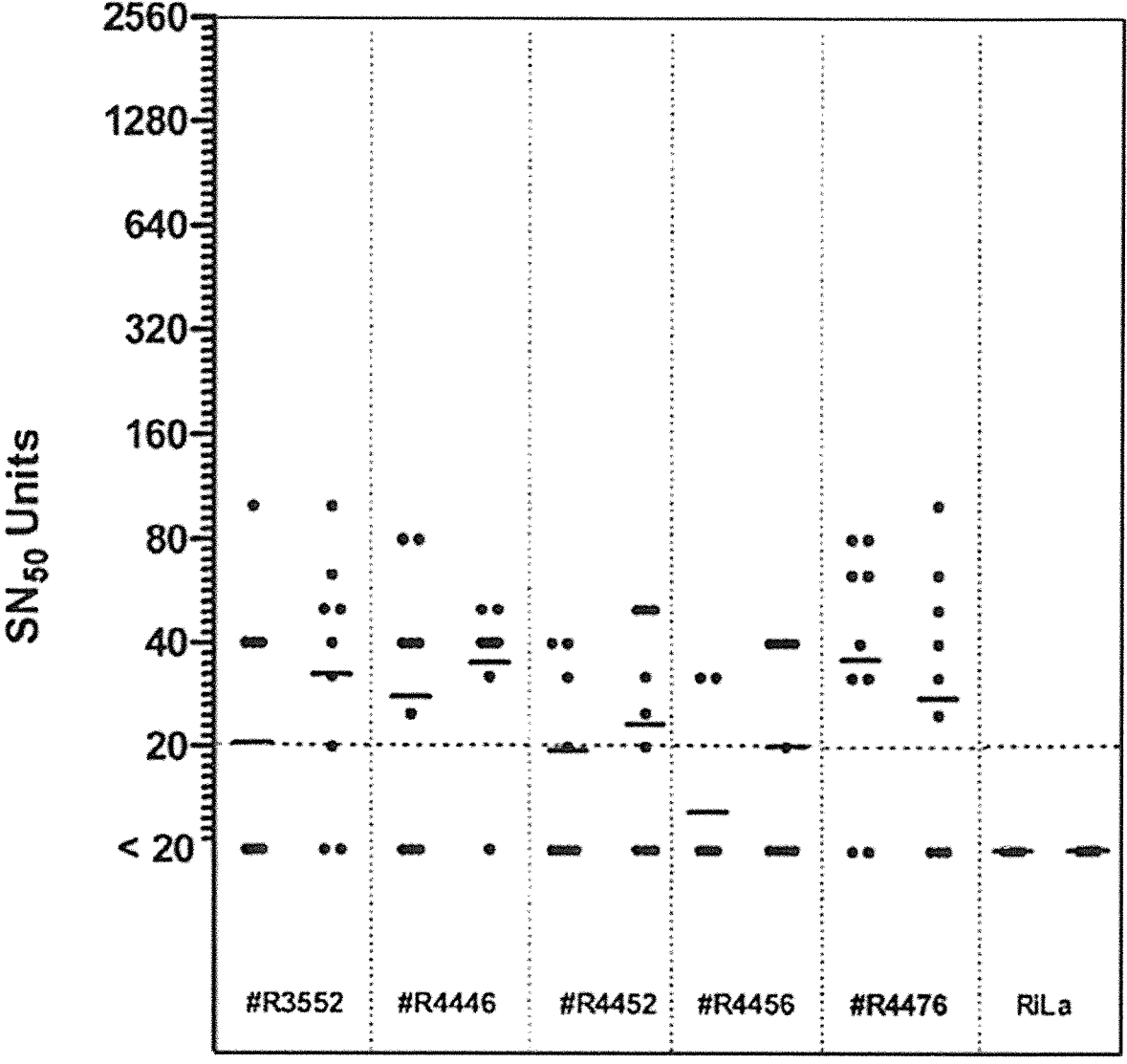

FIG. 39: PRNT50 analysis upon vaccination with DENV mRNA constructs. The figure shows that immunization of hamster with formulated mRNA coding for indicated DENV-3 proteins leads to the production of neutralizing antibodies. Immunization of hamster and subsequent PRNT50 analysis is described in Example 24. PRNT50 titer 20 is indicated by the dashed horizontal line; Horizontal bars indicate the geometric mean titer. The design of immunization experiment is summarized in Table 19.

Figure 40:
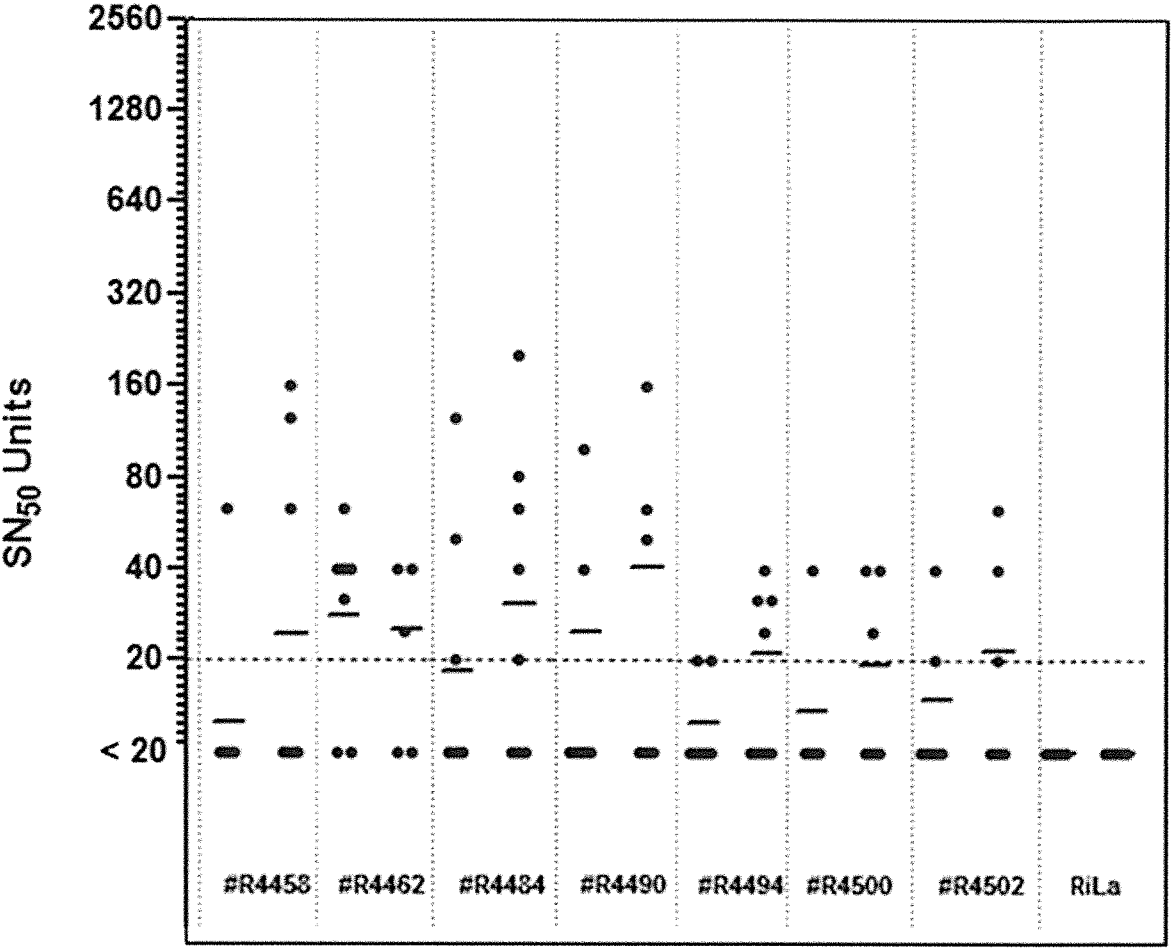

FIG. 40: PRNT50 analysis upon vaccination with DENV mRNA constructs. The figure shows that immunization of hamster with formulated mRNA coding for indicated DENV-3 proteins leads to the production of neutralizing antibodies. Immunization of hamster and subsequent PRNT50 analysis is described in Example 24. PRNT50 titer 20 is indicated by the dashed horizontal line; Horizontal bars indicate the geometric mean titer. The design of immunization experiment is summarized in Table 20.

Figure 41:
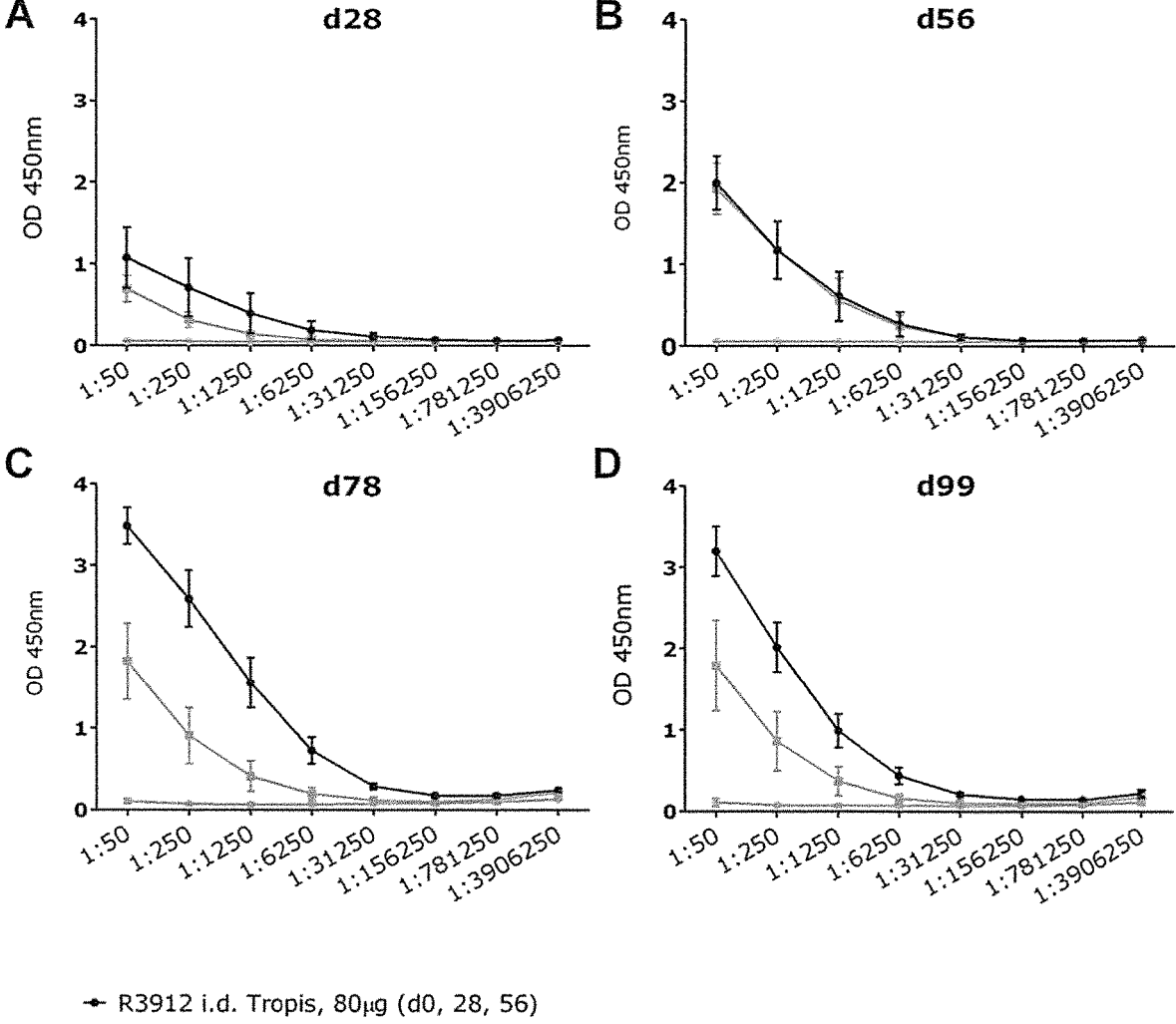

FIG. 41: shows that immunization of NHPs with formulated YFV mRNA induces humoral immune responses in NHPs. (A-D) Binding IgG serum antibodies were measured using ELISA using inactivated YFV VERO cell-derived lysate diluted 1:300 in PBS for coating. The optical density (OD) was measured at 450 nm. Shown are the meant SEM values of the OD450 nm measured at the indicated serum dilution. For further details see Example 25. The design of immunization experiment is summarized in Table 21.

Figure 42:
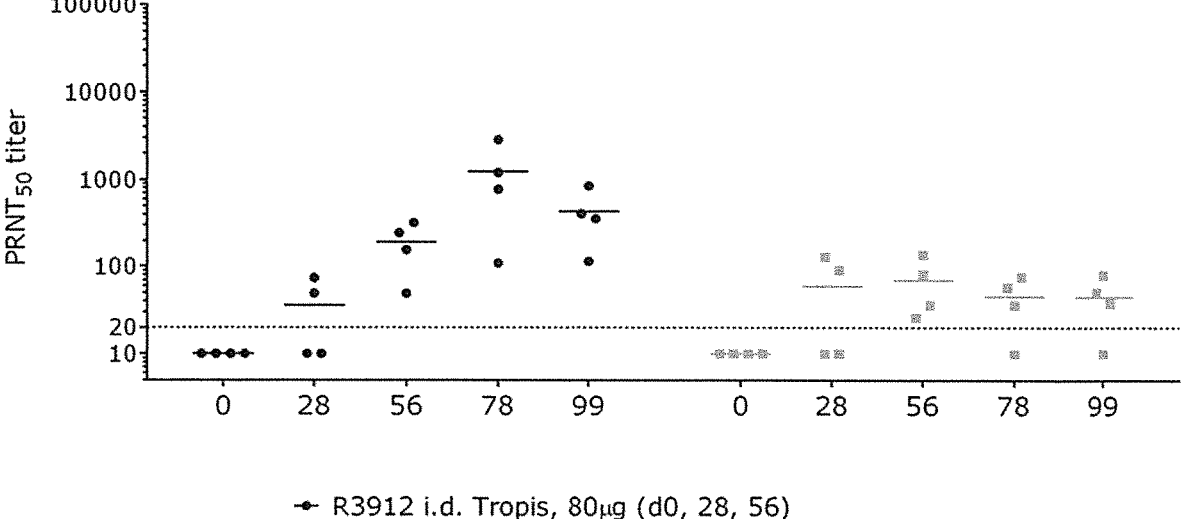

FIG. 42: shows that immunization of NHPs with formulated YFV mRNA induces neutralizing antibodies in NHPs. Neutralizing serum antibodies were measured by the plaque reduction microneutralization test ($\mu$PRNT50). The horizontal bar indicates the geometric mean titer. PRNT50 titers ≥20 are considered as a positive signal. For further details see Example 25. The design of immunization experiment is summarized in Table 21.

Figure 43:
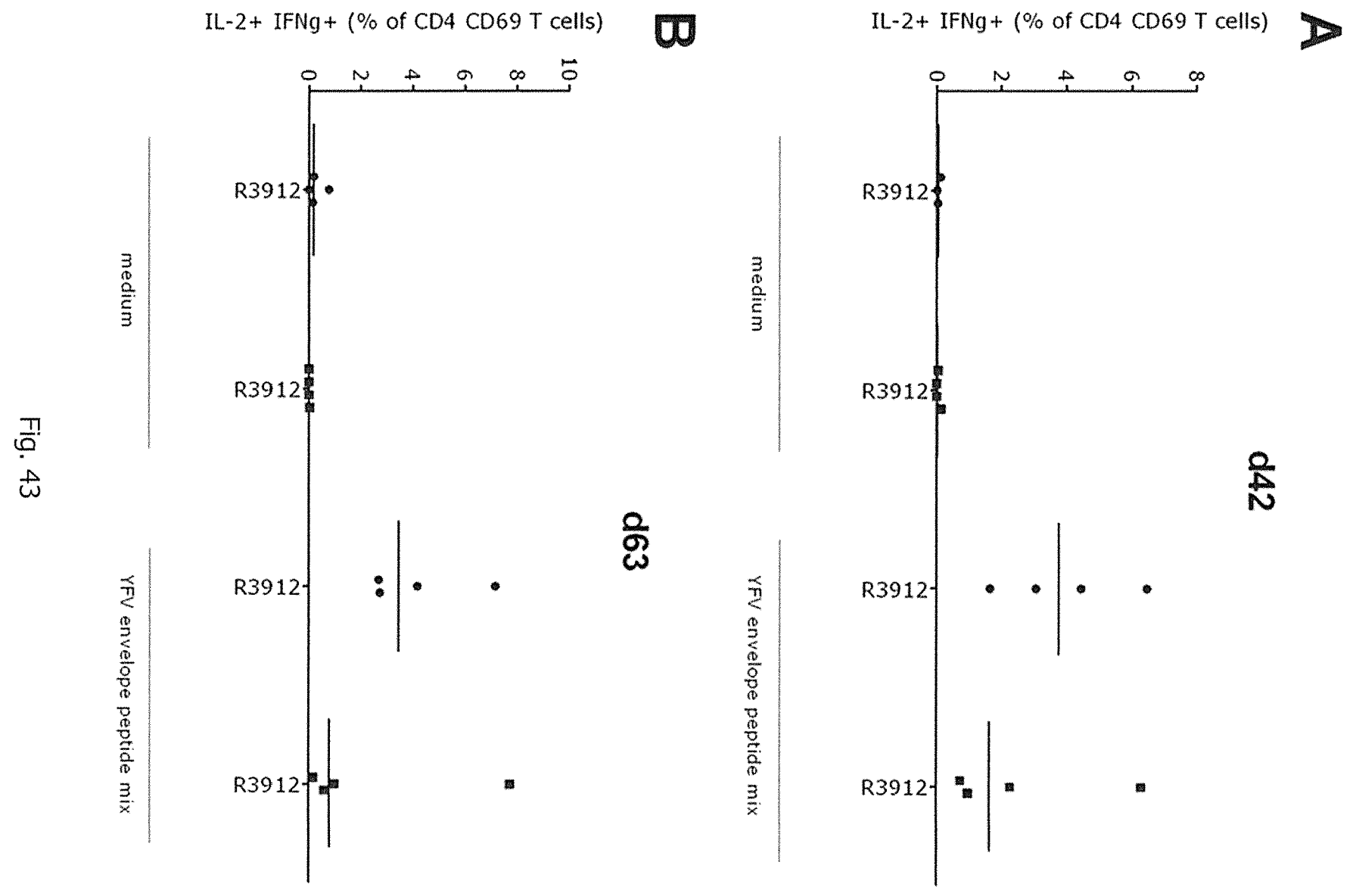

FIG. 43: shows that immunization of NHPs with formulated YFV mRNA induces cellular immune responses in NHPs. (A and B) CD4 T cell responses were analyzed in isolated PBMCs by intracellular cytokine staining using an overlapping peptide library covering the YFV envelope protein for ex-vivo stimulation in the presence of anti-CD28/CD49d for co-stimulation and CD107α-PE antibodies as well as a protein transport inhibitor containing brefeldin A. Buffer was used as control. Depicted are the frequencies of activated (CD69+) CD4+ cells simultaneously producing the cytokines IL-2+ and IFNγ. The horizontal bar indicates the mean. For further details see Example 25. The design of immunization experiment is summarized in Table 21.

Figure 44:
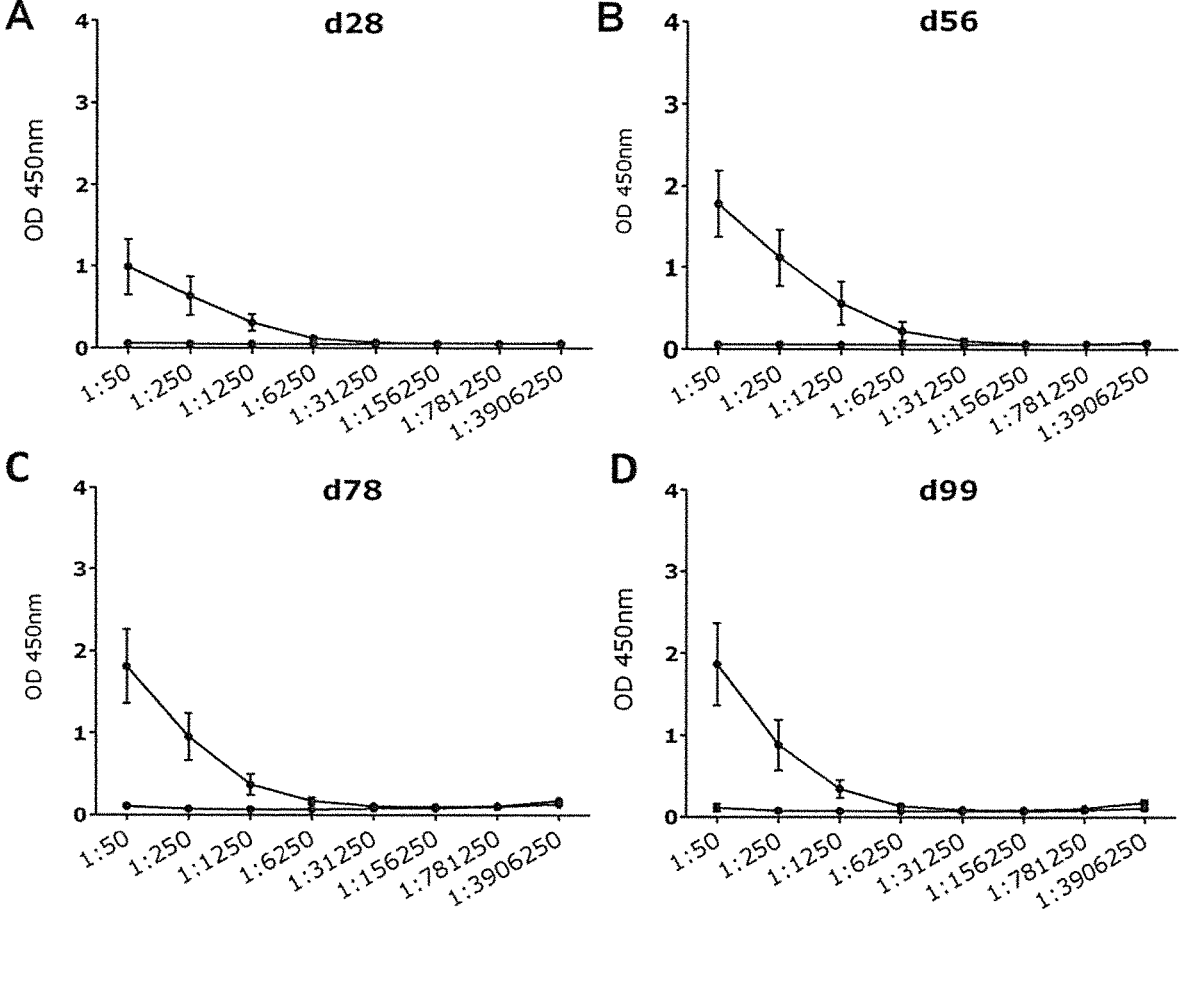

FIG. 44: shows that immunization of NHPs with polymer-lipidoid formulated YFV mRNA induces humoral immune responses in NHPs. (A-D) Binding IgG serum antibodies were measured using ELISA using inactivated YFV VERO cell-derived lysate diluted 1:300 in PBS for coating. The optical density (OD) was measured at 450 nm. Shown are the mean±SEM values of the OD450 nm measured at the indicated serum dilution. For further details see Example 26, study I. The design of immunization experiment is summarized in Table 22.

Figure 45:
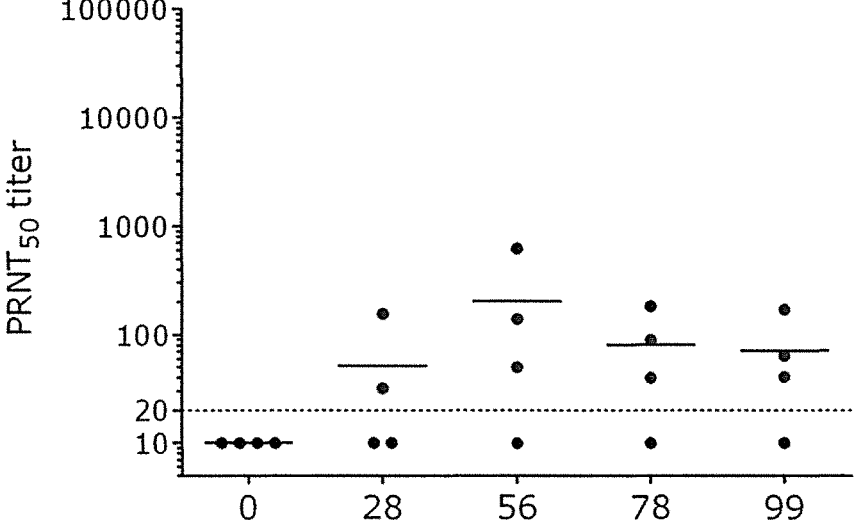

FIG. 45: shows that immunization of NHPs with polymer-lipidoid formulated YFV mRNA induces neutralizing antibodies in NHPs. Neutralizing serum antibodies were measured by the plaque reduction microneutralization test (µPRNT50). The horizontal bar indicates the geometric mean titer. PRNT50 titers >20 are considered as a positive signal. For further details see Example 26, study I. The design of immunization experiment is summarized in Table 22.

FIG. 46: shows that immunization of NHPs with polymer-lipidoid formulated YFV mRNA induces cellular immune responses in NHPs. (A and B) CD4 T cell responses were analyzed in isolated PBMCs by intracellular cytokine staining using an overlapping peptide library covering the YFV envelope protein for ex-vivo stimulation in the presence of anti-CD28/CD49d for co-stimulation and CD107α-PE antibodies as well as a protein transport inhibitor containing brefeldin A. Buffer was used as control. Depicted are the frequencies of activated (CD69+) CD4+ cells simultaneously producing the cytokines IL-2+ and IFNγ. The horizontal bar indicates the mean. For further details see Example 26, study I. The design of immunization experiment is summarized in Table 22.

Figure 47:
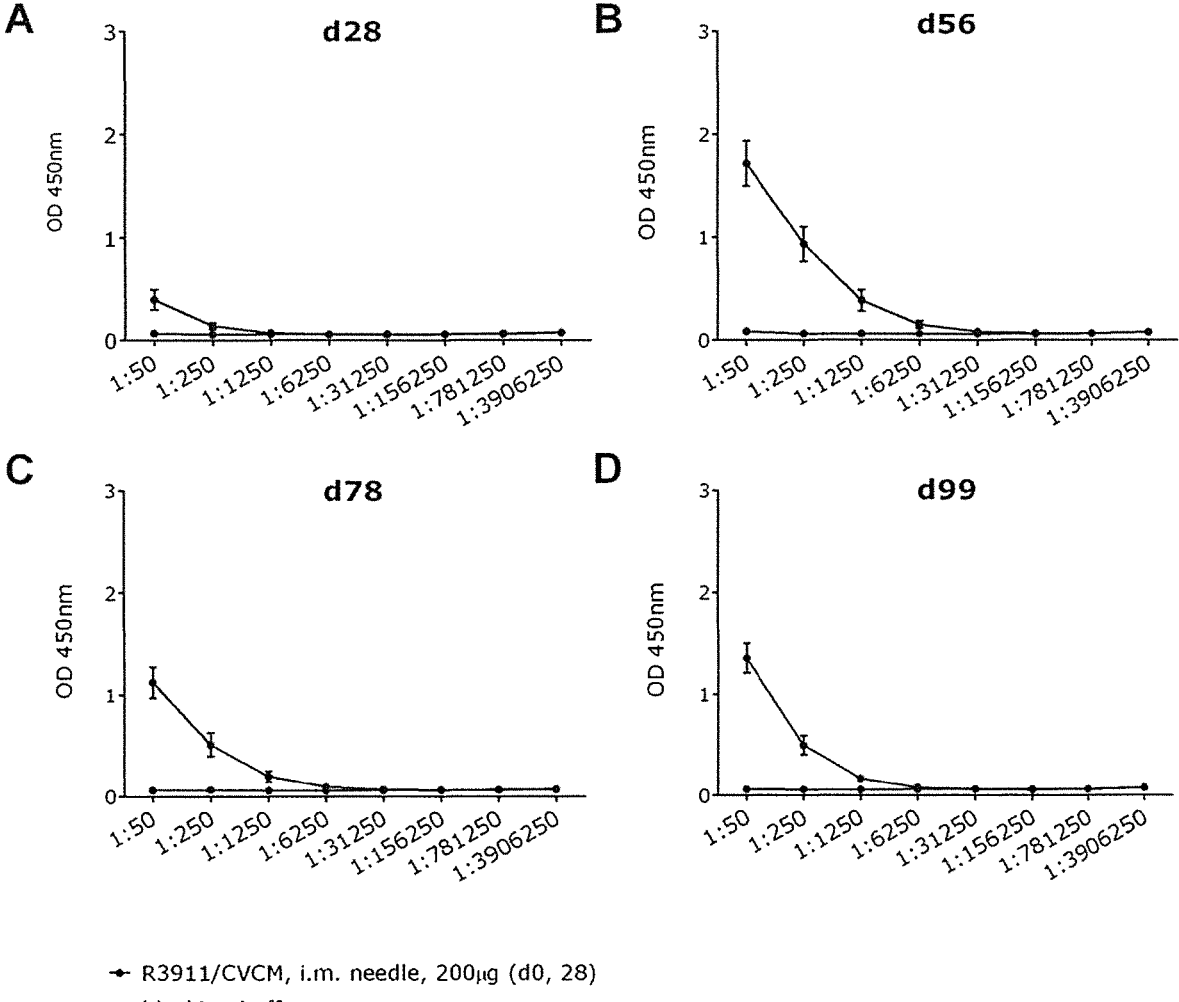

FIG. 47: shows that immunization of NHPs with polymer-lipidoid formulated YFV mRNA vaccine induces humoral immune responses in NHPs. (A-D) Binding IgG serum antibodies were measured using ELISA using inactivated YFV VERO cell-derived lysate diluted 1:300 in PBS for coating. The optical density (OD) was measured at 450 nm. Shown are the mean±SEM values of the OD450 nm measured at the indicated serum dilution. For further details see Example 26, study II. The design of immunization experiment is summarized in Table 23.

Figure 48:
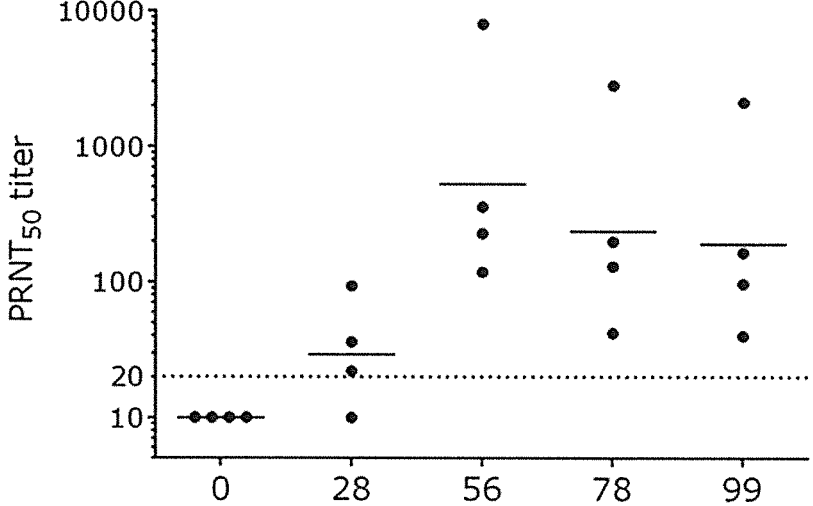

FIG. 48: shows that immunization of NHPs with polymer-lipidoid formulated YFV mRNA vaccine induces neutralizing antibodies in NHPs. Neutralizing serum antibodies were measured by the plaque reduction microneutralization test (µPRNT50). The horizontal bar indicates the geometric mean titer. PRNT50 titers >20 are considered as a positive signal. For further details see Example 26, study II. The design of immunization experiment is summarized in Table 23.

EXAMPLES

The examples shown in the following are merely illustrative and shall describe the present invention in a further way. These examples shall not be construed to limit the present invention thereto.

Yfv Constructs:

The YFV genome has one open reading frame encoding a single polyprotein. The amino terminus of the genome encodes three structural proteins: capsid (C), membrane (M, which is expressed as a precursor to M, prM) and envelope (E) which constitute the virus particle. Seven non-structural proteins are encoded by the remaining part of the virus genome (see FIG. 1). During translation of the polyprotein, the structural proteins are translocated and anchored in the ER by various signal sequences and membrane anchor domains.

YFV polyprotein sequence of strain 17D (NCBI-ID: 11090; GB-ID: P03314) was used to design different YFV mRNA constructs as described in Table 3 (Example section) with reference to the RNA ID (e.g. R2387). Abbreviations for the respective elements as used in the Example section are specified in the description. Schematic diagrams of exemplary YFV constructs as used herein are shown in FIG. 2. Additional information regarding each YFV sequence is as used herein is provided in the sequence listing under the <223> identifier.

Denv Constructs:

The DENV genome has one open reading frame encoding a single polyprotein. The amino terminus of the genome encodes three structural proteins: capsid (C), membrane (M, which is expressed as a precursor to M, prM) and envelope (E) which constitute the virus particle. Seven non-structural proteins are encoded by the remaining part of the virus genome (see FIG. 1). During translation of the polyprotein, the structural proteins are translocated and anchored in the ER by various signal sequences and membrane anchor domains.

Different serotypes derived from DENV strains 1-4 were used to design different DENV mRNA constructs as described in Table 9 (Example section) with reference to the RNA ID (e.g. R3540). Abbreviations for the respective elements as used in the Example section are specified in the description. Schematic diagrams of exemplary DENV constructs as used herein are shown in FIG. 11. Additional information regarding each DENV sequence is provided in the sequence listing under the respective <223> identifier.

Example 1: Preparation of YFV mRNA Constructs for In Vitro and In Vivo Experiments

1.1. Preparation of DNA and mRNA Constructs:

For the present examples, DNA sequences encoding yellow fever virus (YFV) proteins and control constructs were prepared and used for subsequent in vitro transcription reactions. YFV constructs are listed in Table 3 with respective RNA identifiers as used herein, SEQ ID NOs for nucleic acid sequences (mRNA), and SEQ ID NOs for protein sequences. Exemplary schematic drawings YFV constructs are shown in FIG. 2.

TABLE 3

Prepared YFV constructs (Example 1; used abbreviations defined in the description):

| RNA ID | YFV construct description | RNA design and formulation | SEQ ID NO: RNA | SEQ ID NO: protein |
|---|---|---|---|---|
| R2387 | X-SS-prME-XX | mRNA product Design1; wt | 378 | 48 |
| R2388 | X-SS-prME-XX | mRNA product Design1; opt1 | 386 | 48 |
| R2581 | X-SS-prME-XX | mRNA product Design2; opt1 | 470 | 48 |
| R2582/ R3912 | X-SS-prME-XX | mRNA product Design2; opt1; form1 | 470 | 48 |
| R3911 | X-SS-prME-XX | mRNA product Design2; opt1; form2 | 470 | 48 |
| R2401 | X-SS-prME-XX | mRNA product Design1; opt16 | 456 | 48 |
| R2548 | X-SS-prME-TMcFlag-XX | mRNA product Design1; opt1 | 389 | |
| R2549 | X-SS-prME-intFlag-XX | mRNA product Design1; opt1 | 390 | |
| R2554 | X-SS-E-XX | mRNA product Design1; opt1 | 387 | 49 |
| R2587 | C-prME-NS1 | mRNA product Design2; opt1 | 469 | 40 |
| R2588 | C-prME-NS1 | mRNA product Design2; opt1; form1 | 469 | 40 |
| R2607 | SS-prME | mRNA product Design2; opt1 | 473 | 51 |
| R2608 | SS-prME | mRNA product Design2; opt1; form1 | 473 | 51 |
| R2611 | C-prME | mRNA product Design2; opt1 | 468 | 39 |
| R2612 | C-prME | mRNA product Design2; opt1; form1 | 468 | 39 |
| R2615 | SS-prME-NS1 | mRNA product Design2; opt1 | 474 | 53 |
| R2616 | SS-prME-NS1 | mRNA product Design2; opt1; form1 | 474 | 53 |

Additional Control Constructs:

| RNA ID | Construct description | RNA design and formulation | SEQ ID NO: RNA |
|---|---|---|---|
| R1548 | Flu A HA | mRNA product Design1; opt1 | 22 |
| R2429 | Flu A HA | mRNA product Design1; opt1; form | 22 |
| R2569 | luciferase | mRNA product Design1; opt1; form | 21 |

Most DNA sequences were prepared by modifying the wild type encoding DNA sequences by introducing a GC-optimized sequence for stabilization (indicated as "opt1" in Table 2). In addition to GC optimization, construct R2401 was C optimized (indicated as "opt16" in Table 2). Some sequences were introduced into a pCV19 vector and modified to comprise stabilizing sequences derived from alpha-globin 3'"-UTR (muag (mutated alpha-globin 3'-UTR)), a histone-stem-loop structure, and a stretch of 64 adenosine at the 3'-terminal end (poly-A-tail) [A64-N5-C30-histoneSL-N5] (indicated as "mRNA product Design1" in Table 2).

Other sequences were introduced into pCV32 vector to comprise stabilizing sequences derived from 32L_4 5'-UTR ribosomal 5'TOP UTR (32L-4) and 3'-UTR derived from albumin 7, a histone-stem-loop structure, and a stretch of 64 adenosine at the 3'-terminal end (poly-A-tail) [A64-1N5-C30-histoneSL-1N5] (indicated as "mRNA product Design2" in Table 2).

1.2. RNA In Vitro Transcription:

The respective DNA plasmids prepared according to paragraph 1 were transcribed in vitro using DNA dependent RNA T7 polymerase in the presence of a cap analog (m7GpppG) and a nucleotide mixture under suitable buffer conditions. Subsequently the in vitro transcribed mRNA was purified using PureMessenger (CureVac, Tübingen, Germany; WO2008/077592 A1).

1.3. Preparation of Protamine Complexed mRNA:

Some mRNA constructs were furthermore complexed with protamine prior to use in in vivo immunization experiments (indicated as "form1" in Table 2). The mRNA formulation consisted of a mixture of 50% free mRNA and 50% mRNA complexed with protamine at a weight ratio of 2:1. First, mRNA was complexed with protamine by addition of protamine-Ringer's lactate solution to mRNA. After incubation for 10 minutes, when the complexes were stably generated, free mRNA was added, and the final concentration was adjusted with Ringer's lactate solution. 1.4. Preparation of polymer-lipidoid complexed mRNA: Some mRNA constructs were complexed with a polymer-lipidoid prior to use in in vivo immunization experiments (indicated as "form2" in Table 2).

Preparation of Cationic Peptide/Polymer:

20 mg peptide (CHHHHHHRRRRHHHHHHC-NH2; SEQ ID NO: 26361) TFA salt was dissolved in 2 mL borate buffer pH 8.5 and stirred at room temperature for approximately 18h. Then, 12.6 mg PEG-SH 5000 (Sunbright) dissolved in N-methylpyrrolidone was added to the peptide solution and filled up to 3 mL with borate buffer pH 8.5. After 18h incubation at room temperature, the reaction mixture was purified and concentrated by centricon procedure (MWCO 10 kDa), washed against water, and lyophilized. The obtained lyophilisate was dissolved in ELGA water and the concentration of the polymer was adjusted to 10 mg/mL. The obtained polyethylene glycol/peptide polymers (HO-PEG 5000-S—(S—CHHHHHHRRR-RHHHHHHC-S-)7-S-PEG 5000-OH-amino acid component: SEQ ID NO: 26361) were used for further formulation and are hereinafter referred to as PB83.

Preparation of 3-C12-OH Lipidoid:

First, lipidoid 3-C12 was obtained by acylation of tris(2-aminoethyl)amine with an activated lauric (C12) acid derivative, followed by reduction of the amide. Alternatively, it may be prepared by reductive amination with the corresponding aldehyde. Lipidoid 3-C12-OH was prepared by addition of the terminal C12 alkyl epoxide with the same oligoamine according to Love et al., pp. 1864-1869, PNAS, vol. 107 (2010), no. 5, (cf. compound C12 and compound 110 in Love et al. FIG. 1).

Preparation of Compositions with Nanoparticles of Polymer-Lipidoid Complexed YFV mRNA:

First, ringer lactate buffer (RiLa; alternatively e.g. saline (NaCl) or PBS buffer may be used), respective amounts of lipidoid, and respective amounts of a polymer (PB83) were mixed to prepare compositions comprising a lipidoid and a peptide or polymer. Then, the carrier compositions were used to assemble nanoparticles with the mRNA by mixing the mRNA with respective amounts of polymer-lipidoid carrier and allowing an incubation period of 10 min at room temperature such as to enable the formation of a complex between the lipidoid, polymer and mRNA. In order to characterize the integrity of the obtained polymer-lipidoid complexed mRNA particles, RNA agarose gel shift assays were performed. In addition, size measurements were performed (gel shift assay, Zetasizer) to evaluate whether the obtained nanoparticles have a uniform size profile.

Example 2: Expression of YFV Proteins in HeLa Cells and Analysis by FACS

To determine in vitro protein expression of the constructs, HeLa cells were transiently transfected with mRNA encoding YFV antigens and stained using a commercially available anti YF virus specific antibody (sc-58083 from Santa Cruz) and a FITC-coupled secondary antibody (F5262 from Sigma).

HeLa cells were seeded in a 6-well plate at a density of 300,000 cells/well in cell culture medium (RPMI, 10% FCS, 1% L-Glutamine, 1% Pen/Strep), 24h prior to transfection. HeLa cells were transfected with 2.5 μg naked, unformulated mRNA using Lipofectamine 2000 (Invitrogen).

The following mRNA constructs were used in the experiment: R2387:YFV X-SS-prME-XX; R2388:YFV X-SS-prME-XX; R2401:YFV X-SS-prME-XX; R1548: encoding the influenza HA protein as a negative control.

Figure 3:
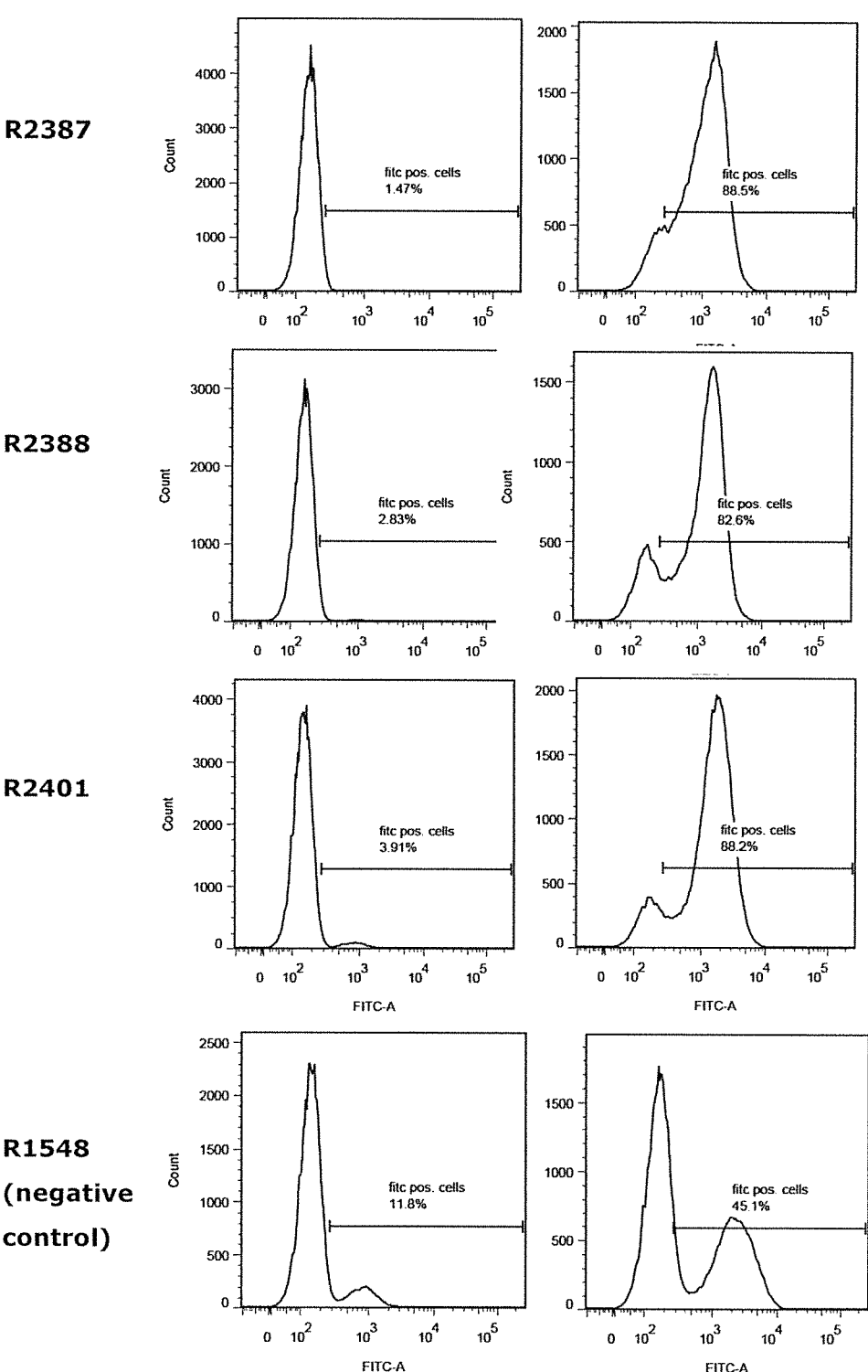
FIG. 3: Expression of YF proteins in HeLa cells and analysis by FACS. The figure shows that transfection of HeLa cells with mRNAs coding for YFV proteins leads to the expression of the encoded YFV E protein. Analysis was performed by FACS. Constructs R2387, R2388, R2401 were used; R1548 encoding the influenza HA protein, served as a negative control. YFV E proteins were stained with a specific antibody and FITC labeled secondary antibody and analyzed by FACS. Left panel: Staining with secondary antibody only. Right panel: Staining with anti YFV E protein antibody. For a detailed description, see Example 2.

24h post transfection, HeLa cells were stained with mouse anti-YF specific antibody (1:50) and anti-mouse FITC labelled secondary antibody (1:500) and subsequently analyzed by flow cytometry (FACS) on a BD FACS Canto II using the FACS Diva software. Quantitative analysis of the fluorescent FITC signal was performed using FlowJo software (Tree Star, Inc.). Results are shown in FIG. 3.
Results:

Compared to the control (R1548) where 45.1% FITC positive cells could be detected, more than 82% prME mRNA transfected cells were FITC positive. This shows that all three tested prME mRNA constructs (R2387, R2388, and R2401) led to the expression of the encoded YFV prME proteins (see FIG. 3).

Example 3: Expression and Secretion of YFV Proteins (Western Blot)

The aim of these experiments was to analyze the expression of the five mRNA constructs and to determine the release of the YFV E protein into the supernatant of transfected HeLa cells. All YFV RNA candidates were designed to produce virus-like particles (VLP) that should be released from producing cells. Moreover, cell lysates were analyzed for E protein expression.

Figure 4:
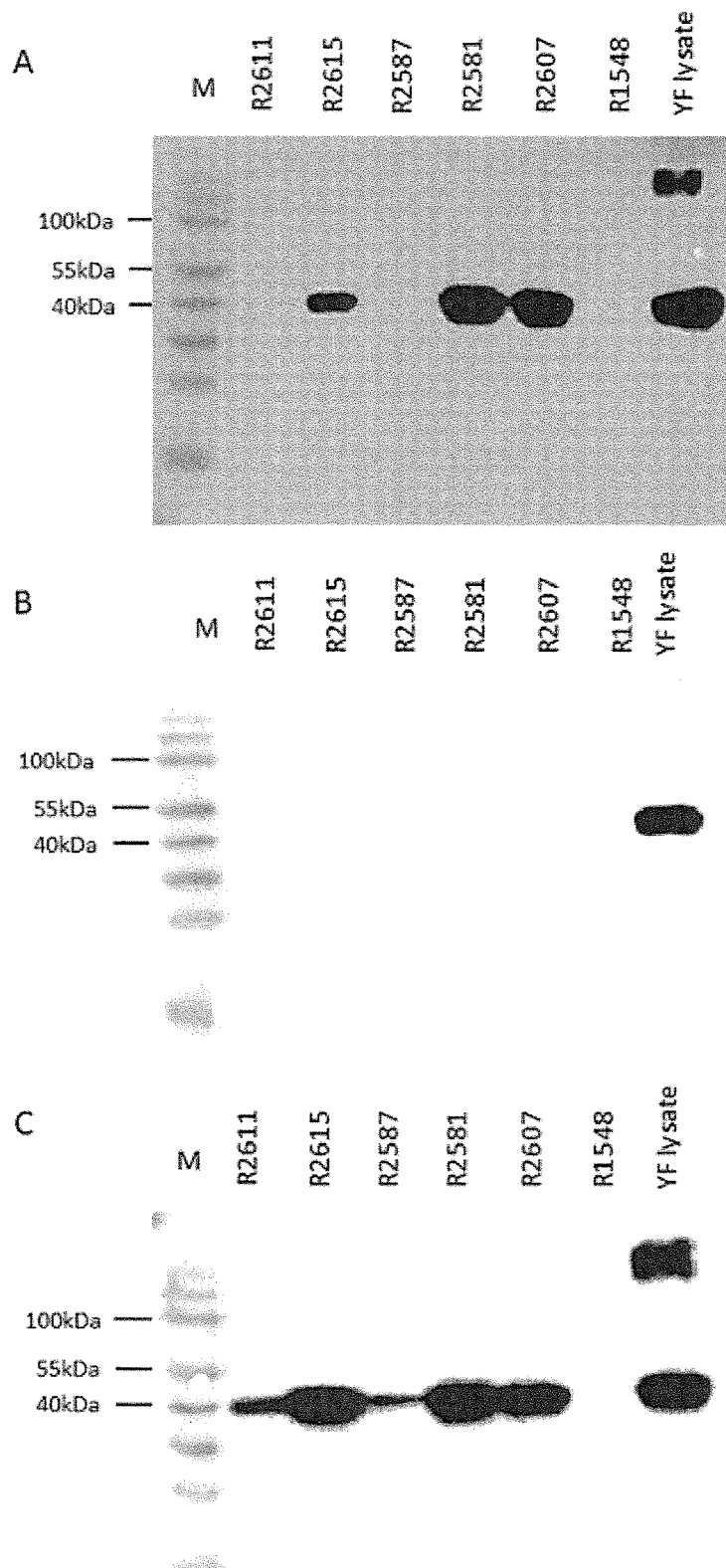
FIG. 4: Expression and secretion of YF proteins (Western blot). The figure shows a western blot to detect E proteins in tissue culture supernatant (A) and cell lysates (C) using an anti YFV E protein specific antibody; (B) shows a western blot to detect beta-actin in tissue culture supernatant as control. Constructs R2611, R2615, R2587, R2581, R2607 were used. R1548 encoding the influenza HA protein, served as a negative control. For a detailed description, see Example 3.

For the analysis of E protein secretion, HeLa cells were transfected with 2.5 μg unformulated mRNA (R2611:C-prME; R2615:SS-prME-NS1; R2587:C-prME-NS1; R2581:X-SS-prME-XX; R2607:SS-prME; R1548:Flu HA (negative control)) using 6 μl of Lipofectamine as the transfection agent and supernatants were harvested 14h post transfection. Supernatants were spun 15 min at 3000 rpm at 4° C. Clarified supernatants were applied on top of 1 ml 20% sucrose cushion (in PBS) and spun 2h at 30000 rpm at 4° C. YFV E protein content was analyzed by Western Blot using anti flavivirus group antigen (4G2; 1:2000 diluted) as primary antibody in combination with secondary anti mouse antibody coupled to HRP, see FIG. 4A. The presence of beta-actin was analyzed as control for cellular contamination (anti actin; Sigma Aldrich; 1:100000 diluted) in combination with secondary anti-mouse antibody coupled to HRP, see FIG. 4B.

For the analysis of E protein in cell lysates, HeLa cells were transfected with 1 μg and 5 μg of unformulated mRNA (R2611; R2615; R2587; R2581; R2607; R1548: Flu HA (negative control)) using 6 μl of Lipofectamine as the transfection agent, and cell lysates were prepared 14h post transfection. Western Blot analysis was performed using anti-flavivirus group antigen (4G2; 1:2000 diluted) as primary antibody in combination with secondary anti-mouse antibody coupled to HRP (see FIG. 4C).
Results:

For three of the tested mRNA constructs (R2615; R2581; R2607) YFV E protein was detectable in the supernatants of transfected HeLa cells (see FIG. 4A). However, the expression of all five constructs was demonstrated in the corresponding cell lysates (see FIG. 4C). Since no beta-actin protein was detectable in the analyzed supernatants (see FIG. 4B), the presence of the viral E protein was considered to be mediated by secretion and not via release by cell death associated with the transfection method.

Example 4: Immunization of Mice with YFV Constructs and Detection of an Antigen-Specific Humoral Response Female BALB/c mice were injected intradermally (id) with formulated mRNAs encoding prME proteins with doses and immunization regimen as indicated in Table 4. As a negative control one group of mice was vaccinated with buffer (ringer lactate, RiLa). The mRNAs were injected id into two injection sites located cranially and caudally on the animal's back. All animals received boost injections on day 14 and day 28. Blood samples were collected on day 56 for the determination of antibody titers.

TABLE 4

| Immunization regimen for indicated animal groups (Example 4) | | | |
|---|---|---|---|
| Group | No. of mice | Injected RNA construct and dose [μg] | Immunization on day |
| 1 | 8 | R2588: YFV C-prME-NS1 (20 μg) | 0/14/28 |
| 2 | 8 | R2608: YFV SS-prME (20 μg) | 0/14/28 |
| 3 | 8 | R2612: YFV C-prME (20 μg) | 0/14/28 |
| 4 | 8 | R2616: YFV SS-prME-NS1 (20 μg) | 0/14/28 |
| 5 | 8 | R2582: YFV X-SS-prME-XX (20 μg) | 0/14/28 |
| 6 | 8 | 100% RiLa | 0/14/28 |
| 7 | 8 | R2582: YFV X-SS-prME-XX (80 μg) | 0/14/28 |

4.1. Determination of Anti YFV Protein Antibodies by ELISA:

ELISA was established using inactivated YFV-infected Vero cell lysate for coating. The specificity for the YFV was confirmed by demonstrating that YFV-specific sera did not react with the lysates of non-infected cells. Coated plates were incubated using respective serum dilutions, and binding of specific antibodies to the YFV antigens was detected using biotinylated isotype specific anti-mouse antibodies followed by streptavidin-HRP (horse radish peroxidase) with ABTS as substrate. Endpoint titers of antibodies directed against the YFV antigens were measured by ELISA on day 56 after three immunizations. Results are shown in FIG. 5.

Results:

Assessment of the humoral immune response after immunizations revealed that 20 µg of the respective mRNAs (R2588, R2608, R2616, and R2582) induced yellow fever specific IgG1 and IgG2a antibody titers. Three immunizations with 20 µg RNA R2582 induced similar IgG1 and IgG2a titers as compared to 80 µg RNA R2582 demonstrating the induction of a humoral immune response also at the lower dose of 20 µg (see FIG. 5).

Example 5: Immunization of Mice with YFV Constructs and Detection of an Antigen-Specific T-Cell Response (ICS by FACS Analysis)

In order to demonstrate the induction of YFV specific CD4+ and CD8+ T cells, female BALB/c mice were injected four times at weekly intervals with formulated mRNAs encoding the prME antigen as shown in Table 5. As a negative control, mice were treated with Ringer lactate (RiLa) buffer. The formulated mRNAs or the buffer, respectively, were injected intradermally into two injection sites located cranially and caudally on the animal's back.

TABLE 5

Immunization regimen for indicated animal groups (Example 5):

| Group | No. of mice | Injected RNA construct and dose [µg] | Immunizations on day |
|---|---|---|---|
| 1 | 8 | R2588: YFV C-prME-NS1 (80 µg) | 0/7/14/21 |
| 2 | 8 | R2608: YFV SS-prME (80 µg) | 0/7/14/21 |
| 3 | 8 | R2612: YFV C-prME (80 µg) | 0/7/14/21 |
| 4 | 8 | R2616: YFV SS-prME-NS1 (80 µg) | 0/7/14/21 |
| 5 | 8 | R2582: YFV X-SS-prME-XX (80 µg) | 0/7/14/21 |
| 6 | 8 | RiLa (control) | 0/7/14/21 |

5.1. Intracellular Cytokine Staining:

Splenocytes from vaccinated mice were isolated according to a standard protocol on day 26. Briefly, isolated spleens were grinded through a cell strainer and washed in PBS/1% FBS followed by red blood cell lysis. After an extensive washing step with PBS/1% FBS splenocytes were seeded into 96-well plates ($2 \times 10^6$ cells/well). The cells were stimulated with a mixture of four YFV E protein specific peptides (5 µg/ml of each peptide derived from YFV E protein stretch; TKIQYVIRAQLHVGA (aa133-aa147 of YFV E), RKVCYNAVLTHVKIN (aa57-aa71 YFV E), IPVIVADDL (aa332-aa340 YFV E), and CYNAVLTHV (aa60-aa68 YFV E)) in the presence of 2.5 µg/ml of an anti-CD28 antibody (BD Biosciences) for 6h at 37° C. in the presence of a protein transport inhibitor. After stimulation cells were washed and stained for intracellular cytokines using the Cytofix/Cytoperm reagent (BD Biosciences) according to the manufacturer's instructions. The following antibodies were used for staining: CD3-FITC (1:100), CD8-PE-Cy7 (1:200), TNF-PE (1:100), IFNγ-APC (1:100) (eBioscience), CD4-BD Horizon V450 (1:200) (BD Biosciences) and incubated with Fcγ-block diluted 1:100. Aqua Dye was used to distinguish live/dead cells (Invitrogen). Cells were acquired using a Canto II flow cytometer (Beckton Dickinson). Flow cytometry data was analyzed using FlowJo software (Tree Star, Inc.). Results are shown in FIG. 6.

Results:

All YFV mRNAs tested induced YFV E protein specific CD4+ and CD8+ T cells that produce IFN-γ or TNF-α. The induction of the T cells was antigen-specific, since spleen cells of control mice vaccinated with buffer did not respond to the stimulation using YFV-specific peptides (see FIG. 6). In conclusion, all tested yellow fever mRNAs induced an antigen specific T-cell response.

Example 6: Immunization of Mice with YFV Constructs: Antibody Detection

Female BALB/c mice were vaccinated three times (day 0, day 14 and day 28) with formulated mRNAs encoding prME antigens (R2608, R2588, R2612, R2616, and R2582) or with indicated controls. Mice were injected intradermally (two injections with 50 µl in the back). As negative controls, mice were injected with buffers or mRNA encoding luciferase (R2569). As positive control, mice were injected with inactivated YF virus (see Table 6).

TABLE 6

Immunization regimen for indicated animal groups (Example 6)

| Group | Injected RNA construct and dose [µg] | Blood collection on day |
|---|---|---|
| 1 | R2608: YFV SS-prME (80 µg) | 36/56 |
| 2 | R2588: YFV C-prME-NS1 (80 µg) | 36/56 |
| 3 | R2612: YFV C-prME (80 µg) | 36/56 |
| 4 | R2616: YFV SS-prME-NS1 (80 µg) | 36/56 |
| 5 | R2582: YFV X-SS-prME-XX (80 µg) | 36/56 |
| 6 | R2569: Luciferase (80 µg) | 36/56 |
| 7 | inactivated YF virus + ALOOH (control) | 36/56 |
| 8 | buffer + ALOOH (control) | 36/56 |
| 9 | RiLa (control) | 36/56 |

Results:

As shown in FIG. 7, a humoral immune response was induced by the mRNA constructs. The constructs R2608, R2616 and R2582 induced similar titers as observed for immunization with inactivated YF virus (positive control).

Example 7: Immunization of Mice with YF Constructs: Plaque Reduction Neutralization Test (PRNT)

Female BALB/c mice were vaccinated two or three times with formulated mRNAs encoding prME proteins (R2608, R2588, R2612, R2616, and R2582) and with indicated controls. Mice were injected intradermally ($2 \times 50$ µl in the back). As negative controls, mice were injected with buffers or mRNA encoding luciferase (R2569). As positive control, mice were injected with inactivated YF virus (see Table 6 in Example 6).

7.1. YF Virus Plaque Reduction Neutralization Test (PRNT50):

Sera were analyzed by the plaque reduction neutralization test (PRNT50). Briefly, serum samples were incubated with YF virus. That mixture was used to infect cultured cells, and the reduction in the number of plaques was detected.

Results:

As shown in FIG. 8, virus neutralizing antibodies were induced by the constructs R2608, R2588, R2616 and R2582 with levels comparable to the YF virus (inactivated) vaccinated mice. The R2616 and R2582 constructs induced highest PRNT50 titers. Particularly the mRNA construct R2582 (Group 5) comprising the N-terminal and C-terminal overhangs induced high virus neutralizing antibodies.

Example 8: Immunization of Hamsters with YFV
prME Constructs and Plaque Reduction
Neutralization Test 5 weeks old Syrian hamsters (n=10/group) were treated id
with 80 μg of R2582 YF mRNA administered in a prime/
boost/boost regimen on day 0, 21 and 35 (see Table 7).
Stamaril© was used as a positive control and administered
once on day 0 (i.m., one full human dose). A control mRNA
(R2569 encoding luciferase), the buffers for mRNA (Ringer
Lactate) and Stamaril© (in buffer 072) were used as negative
controls. YFV neutralizing antibody titers (PRNT50) of
individual or pooled sera were determined in samples col-
lected at each immunization time point and 2 weeks after the
last boost (days 21, 36 and 50).

TABLE 7

| | | Immunization regimen for indicated animal groups (Example 8) | |
| Group | No. of hamsters | Injected RNA construct and dose [μg] | Blood collection on day |
|---|---|---|---|
| 1 | 10 | R2582: YFV X-SS-prME-XX (80 μg) | 21/36/50 |
| 2 | 10 | Stamaril ® | 21/36/50 |
| 3 | 10 | R2569: luciferase (80 μg) | 21/36/50 |
| 4 | 10 | RiLa (control) | 21/36/50 |
| 5 | 10 | buffer 072 | 21/36/50 |

Results:

As shown in FIG. 9, immunization of hamsters with YFV
mRNA R2582 led to the induction of virus neutralizing
antibodies with comparable levels as observed for the YFV
vaccine Stamaril©.

Example 9: Immunization of Non-Human Primates
with YFV Constructs: Antibody Detection and
Virus Neutralization Assay Cynomolgus macaques (n=4) were vaccinated with the
indicated amounts of R2582 YFV mRNA administered
intradermally (id) or intramuscularly (im) with or without a
jet injection device ("jet") in a prime/boost/boost regimen on
day 0, 28 and 56 (see Table 8). Full human dose of the YFV
vaccine Stamaril© was used as a positive control and
administered subcutaneously (sc) once on day 0.

TABLE 8

| | Immunization regimen for indicated animal groups (Example 9) | | |
| Group | Injected RNA construct and dose [μg] | route and volume | Blood collection on day |
|---|---|---|---|
| 1 | R2582: YFV X-SS-prME-XX (240 μg) | id; 3 × 100 μl | 29/43/57 |

TABLE 8-continued

| | Immunization regimen for indicated animal groups (Example 9) | | |
| Group | Injected RNA construct and dose [μg] | route and volume | Blood collection on day |
|---|---|---|---|
| 2 | R2582: YFV X-SS-prME-XX (240 μg) | id; jet; 3 × 100 μl | 29/43/57 |
| 3 | Stamaril ® (full human dose) | sc | 29/43/57 |
| 4 | R2582: YFV X-SS-prME-XX (400 μg) | im; 1 × 500 μl | 29/43/57 |
| 5 | R2582: YFV X-SS-prME-XX (400 μg) | im; jet, 3 × 250 μl | 29/43/57 |

9.1. ELISA:

ELISA was performed using inactivated YFV-infected
Vero cell lysate for coating. Coated plates are incubated
using respective serum dilutions, and binding of specific
antibodies to the YFV antigens was detected using bioti-
nylated isotype specific anti-mouse antibodies in combina-
tion with streptavidin-HRP (horse radish peroxidase) with
ABTS substrate. Endpoint titers of antibodies directed
against the YFV antigens were measured by ELISA on day
29, 43 and 57, shown in FIG. 10A.

9.2. YF Virus Plaque Reduction Neutralization Test
(PRNT50):

Sera were analyzed by the plaque reduction neutralization
test (PRNT50). Briefly, serum samples were incubated with
YF virus. That mixture was used to infect cultured cells, and
the reduction in the number of plaques was determined.
Results are shown in FIG. 10B.

Results:

As shown in FIG. 10, immunization of Cynomolgus
macaques with YFV mRNA R2582 led to the production of
YF-specific antibodies with levels comparable to the YFV
vaccine Stamaril® (immunization regimen shown in Table
8). The highest levels of YFV-specific antibodies were
observed upon application of 240 μg intradermally via a jet
device (see FIG. 10A) which were even higher as the levels
as induced by Stamaril®. Moreover, robust titers of neu-
tralizing antibodies were detected for immunization with
240 μg mRNA, applied intradermally (jet and conventional)
and intramuscularly (jet device) (see FIG. 10B).

Example 10: Preparation of DENV mRNA
Constructs for In Vitro and In Vivo Experiments DNA and RNA preparation was performed according to
Example 1. An overview of DENV constructs used in the
following experiments is provided in Table 9, where respec-
tive RNA identifiers, SEQ ID NOs for nucleic acid
sequences, and SEQ ID NOs for protein sequences are
indicated. Schematics of DENV constructs are shown in
FIG. 11 A-D.

TABLE 9

| | Prepared DENV constructs (Example 10; used abbreviations defined in the description) | | | |
| RNA ID | DENV construct description | RNA design and formulation | SEQ ID NO: RNA | SEQ ID NO: Protein |
|---|---|---|---|---|
| R3540 | DENV-1 SSc-prME | design 2; GC opt; form1 | 2560 | 979 |
| R3542 | DENV-1 SSc-prMEdelstem_TM-JEV | design 2; GC opt; form1 | 2562 | 981 |
| R3544 | DENV-1 SSm-delTM | design 2; GC opt; form1 | 26357 | 26346 |
| R3782 | DENV-1 C-P2A-SSc-prME | design 2; GC opt; form1 | 2563 | 982 |
| R3546 | DENV-2 SSc-prME | design 2; GC opt; form1 | 2571 | 1006 |

TABLE 9-continued

Prepared DENV constructs (Example 10; used abbreviations defined in the description)

| RNA ID | DENV construct description | RNA design and formulation | SEQ ID NO: RNA | SEQ ID NO: Protein |
|---|---|---|---|---|
| R3548 | DENV-2 SSc-prMEdelstem_TM-JEV | design 2; GC opt; form1 | 2573 | 1008 |
| R3550 | DENV-2 SSm-EdelTM | design 2; GC opt; form1 | 2574 | 1009 |
| R3784 | DENV-2 C-P2A-SSc-prME | design 2; GC opt; form1 | 2575 | 1010 |
| R3560 | DENV-4 SSc-prME | design 2; GC opt; form1 | 2583 | 1034 |
| R3562 | DENV-4 SSc-prMEdelstem_TM-JEV | design 2; GC opt; form1 | 2585 | 1036 |
| R3564 | DENV-4 SSm-EdelTM | design 2; GC opt; form1 | 2586 | 1037 |
| R3788 | DENV-4 C-P2A-SSc-prME | design 2; GC opt; form1 | 2587 | 1038 |
| R3552 | DENV-3 SSc-prME | design 2; GC opt; form1 | 2595 | 1066 |
| R3554 | DENV-3 SSc-prMEdelstem_TM-JEV | design 2; GC opt; form1 | 2599 | 1070 |
| R3786 | DENV-3 C-P2A-SSc-prME | design 2; GC opt; form1 | 2601 | 1072 |
| R3790 | DENV-3 SSc-prME-NS1 | design 2; GC opt; form1 | 2633 | 1104 |
| R3792 | DENV-3 SSc-prME-NS1-[IRES]-NS3 | design 2; GC opt; form1 | 2636 | |
| R3794 | DENV-3 NS3-[IRES]-SSC-prME-NS1 | design 2; GC opt; form1 | 2637 | |
| R3556 | DENV-3 SSm-EdelTM | design 2; GC opt; form1 | 2600 | 1071 |
| R3800 | DENV-3 SStPA-WHbcAg-linker-EdelTM | design 2; GC opt; form1 | 2635 | 1106 |
| R3802 | DENV-3 SStPA-WHbcAg-linker-EdelTM-[IRES]-NS3 | design 2; GC opt; form1 | 2639 | |
| R3796 | DENV-3 SSm-EdelTM-linker-ferritin | design 2; GC opt; form1 | 2634 | 1105 |
| R3798 | DENV-3 SSm-EdelTM-linker-ferritin-[IRES]-NS3 | design 2; GC opt; form1 | 2638 | |
| R3804 | DENV-3 NS3 | design 2; GC opt; form1 | 1360 | 1055 |
| R3558 | DENV-3 SSc-prME(R186L) | design 2; GC opt; form1 | 2597 | 1068 |
| R4446 | DENV-3 SSopt-prME(R186L) | design 2; GC opt; form1 | 2611 | 1082 |
| R3765 | DENV-3 SSc-prME(F108S) | design 2; GC opt; form1 | 2596 | 1067 |
| R4458 | DENV-3 SSopt-prME(F108S) | design 2; GC opt; form1 | 2603 | 1074 |
| R3780 | DENV-3 SSc-prME(A265T) | design 2; GC opt; form1 | 2598 | 1069 |
| R4448 | DENV-3 SSopt-prME(A265T) | design 2; GC opt; form1 | 2616 | 1087 |
| R4450 | DENV-3 SSopt-prME(R186L), (A265T) | design 2; GC opt; form1 | 2621 | 1092 |
| R4452 | DENV-3 SSopt-prMEdelstem_TM, (R186L), (A265T)-JEV | design 2; GC opt; form1 | 2631 | 1102 |
| R4454 | DENV-3 SSopt-pr(D104A)ME(R186L), (A265T) | design 2; GC opt; form1 | 2623 | 1094 |
| R4456 | DENV-3 SSopt-pr(D104A)MEdelstem_TM, (R186L), (A265T)-JEV | design 2; GC opt; form1 | 2628 | 1099 |
| R4460 | DENV-3 SSopt-pr(D104A)ME(F108S) | design 2; GC opt; form1 | 2622 | 1093 |
| R4462 | DENV-3 SSopt-pr(D104A)MEdelstem_TM, (F108S)-JEV | design 2; GC opt; form1 | 2627 | 1098 |
| R4464 | DENV-3 SSopt-pr(D104A)ME(F108S), (R186L), (A265T) | design 2; GC opt; form1 | 2624 | 1095 |
| R4466 | DENV-3 SSopt-pr(D104A)MEdelstem_TM, (F108S), R186L, (A265T)-JEV | design 2; GC opt; form1 | 2629 | 1100 |
| R4468 | DENV-3 SSopt-prMEdel101-107, (R99P), (F108N) | design 2; GC opt; form1 | 2625 | 1096 |
| R4470 | DENV-3 SSopt-prMEdelstem_TM, del101-107, (R99P), (F108N)-JEV | design 2; GC opt; form1 | 2632 | 1103 |
| R4472 | DENV-3 SSopt-prME(H27N) | design 2; GC opt; form1 | 2604 | 1075 |
| R4480 | DENV-3 SSopt-prME(G28C), (H242C) | design 2; GC opt; form1 | 2620 | 1091 |
| R4474 | DENV-3 SSopt-prME(H259N) | design 2; GC opt; form1 | 2614 | 1085 |
| R4476 | DENV-3 SSopt-prMEdelstem_TM, (H259N)-JEV | design 2; GC opt; form1 | 2630 | 1101 |
| R4482 | DENV-3 SSopt-prME(H149N) | design 2; GC opt; form1 | 2609 | 1080 |
| R4484 | DENV-3 SSopt-prME(S184F) | design 2; GC opt; form1 | 2610 | 1081 |
| R4486 | DENV-3 SSopt-prME(T76I) | design 2; GC opt; form1 | 2605 | 2605 |
| R4488 | DENV-3 SSopt-prME(N89D) | design 2; GC opt; form1 | 2606 | 1077 |
| R4490 | DENV-3 SSopt-prME(Y96H) | design 2; GC opt; form1 | 2607 | 1078 |
| R4492 | DENV-3 SSopt-prME(K110E) | design 2; GC opt; form1 | 2608 | 1079 |
| R4494 | DENV-3 SSopt-prME(N240S) | design 2; GC opt; form1 | 2612 | 1083 |
| R4496 | DENV-3 SSopt-prME(M258L) | design 2; GC opt; form1 | 2613 | 1084 |
| R4478 | DENV-3 SSopt-prME(H259R) | design 2; GC opt; form1 | 2615 | 1086 |
| R4498 | DENV-3 SSopt-prME(S296G) | design 2; GC opt; form1 | 2617 | 1088 |
| R4500 | DENV-3 SSopt-prME(S311R) | design 2; GC opt; form1 | 2618 | 1089 |
| R4502 | DENV-3 SSopt-prME(K321T) | design 2; GC opt; form1 | 2619 | 1090 |

Example 11: In Vitro Characterization of DENV Protein Expression in HeLa Cells by Western Blot and FACS In order to determine in vitro protein expression of the constructs, HeLa cells were transiently transfected with mRNA encoding DENV antigens and probed using a pan-flaviviral anti-E protein antibody (4G2; Sanofi Pasteur) for protein detection via western blot and FACS.

24h prior to transfection HeLa cells were seeded in a 6-well plate at a density of 4×105 cells/well in cell culture medium (RPMI, 10% FCS, 1% L-Glutamine, 1% Pen/Strep). HeLa cells were transfected with 1 µg and 2 µg formulated mRNA (R3540: DENV-1 SSc-prME; R3542: DENV-1 SSc-prMEdelstem_TM-JEV; R3544: DENV-1 SSm-EdelTM; R3546: DENV-2 SSc-prME; R3548:

DENV-2 SSc-prMEdelstem_TM-JEV; R3550: DENV-2 SSm-EdelTM; R3552: DENV-3 SSc-prME; R3554: DENV-3 SSc-prMEdelstem_TM-JEV; R3556: DENV-3 SSm-EdelTM; R3558: DENV-3 SSc-prME(R186L); R3560: DENV-4 SSc-prME; R3562: DENV-4 SSc-prMEdelstem_TM-JEV; R3564: DENV-4 SSm-EdelTM; R2582: YFV X-SS-prME-XX) using Lipofectamine 2000 (Invitrogen). As a negative control, RiLa buffer was used for transfection. As a positive control, R2582 (YFV X-SS-prME-XX) was used.

11.1. FACS:

Intracellular flow cytometric staining was performed 20-24h day post transfection using 4G2 antibody (1:100) followed by secondary anti mouse FITC antibody (1:500) and subsequently analyzed by flow cytometry (FACS) on aa BD FACS Canto II using the FACS Diva software. Quantitative analysis of the fluorescent FITC signal was performed using FlowJo software (Tree Star, Inc.). Results are shown in FIG. 12.

11.2. Western Blot:

24 hours post transfection, HeLa cells were detached by trypsin-free/EDTA buffer, harvested, and cell lysates prepared. Cell lysates were subjected to SDS-PAGE under non-denaturating/non-reducing followed by western blot detection. For DENV protein detection, a pan-flaviviral mouse anti E protein antibody (4G2; Sanofi Pasteur; 1:2000) followed by goat anti mouse antibody coupled to HRP. In addition, virus like particles (VLP) formation was assessed in HeLa cell supernatants. VLP were isolated using by centrifugation through a 20% sucrose cushion. Moreover the presence of β-actin was analyzed as control for cellular contamination of the supernatants or VLP preparations (anti β-actin; Sigma Aldrich; 1:10000 diluted) in combination with secondary α-mouse antibody coupled to HRP. Results are shown in FIG. 13.

Results:

The expression of all 13 DENV mRNA constructs was demonstrated in vitro by western blot and intracellular flow cytometry. Moreover, for all SSc-prME and SSc-prMEdelstem_TM-JEV constructs, E protein could be detected in supernatants and VLP preparations, suggesting that DENV SSc-prME and SSc-prMEdelstem_TM-JEV mRNA constructs lead to E protein release and VLP formation. Particularly the mRNA constructs SSc-prMEdelstem_TM-JEV seem to be beneficial for expression and VLP formation. Results of the in vitro experiments are summarized in FIG. 14.

Example 12: Immunization of Mice with DENV Constructs and Detection of an Antigen-Specific Humoral Response Female BALB/c mice (n=10/group) were injected intradermally (i.d.) on day 0, 21 and 42 with 40 µg formulated mRNAs encoding DENV proteins. As a negative control, one group of mice was vaccinated with buffer (ringer lactate). Blood samples were collected on day 21, 42 and 56 or 70 for the determination of antibody titers.

12.1. Determination of Anti DENV Protein Antibodies by ELISA:

DENV antigen-specific IgG1 and IgG2a antibody responses were analyzed by ELISA. The ELISA was established using UV-inactivated CYD1-4 viruses for coating. CYD are recombinant viruses containing prM and E sequences from the respective DENV serotype inserted into the backbone of the YFV 17D. Coated plates were incubated using respective serum dilutions, and binding of specific antibodies to DENV antigens was detected using biotinylated isotype specific anti-mouse antibodies in combination with streptavidin-HRP with amplex substrate.

Results:

All groups immunized with the different DENV-1 mRNAs showed comparable median IgG2a titers. However, the SSc-prMEdelstem_TM-JEV immunized animals exhibited the highest IgG1 titers with the lowest variance within the group (FIG. 15A). Similar results were observed for animals vaccinated with the DENV-2 mRNAs. All groups immunized with the different DENV-2 mRNAs showed IgG1 and IgG2a titers above the RiLa buffer control levels. Animals vaccinated with SSc-prMEdelstem_TM-JEV exhibited the highest IgG1 and IgG2a median titer with the lowest variance within the group (FIG. 15B). All groups immunized with the different DENV-3 mRNAs showed IgG2a titers above the RiLa buffer control levels (FIG. 15C). The R3554 (SSc-prMEdelstem_TM-JEV) immunized animals exhibited the highest IgG1 and IgG2a titers. The ELISA analysis of the DENV-4 samples showed substantial IgG1 and IgG2a responses with comparable median titers measured for all three vaccinated groups at day 70 (FIG. 15D).

These data suggest that among the different variants of the DENV E protein tested here, mRNA encoding SSc-prMEdelstem_TM-JEV induced the highest IgG1 and IgG2a titers upon intradermal administration in mice.

Example 13: In Vitro Characterization of DENV-1 and DENV-2 Capsid C-P2A-SSC-prME Expression in HeLa Cells by Western Blot and FACS In order to determine in vitro protein expression of the constructs R3782 and R3784, HeLa cells were transiently transfected with 1 µg and 2 µg formulated mRNA encoding DENV capsid constructs (R3542: DENV-1 SSc-prMEdelstem_TM-JEV; R3782: DENV-1 C-P2A-SSc-prME; R3548: DENV-2 SSc-prMEdelstem_TM-JEV; R3784: DENV-2 C-P2A-SSc-prME) and probed using a pan-flaviviral anti-E protein antibody (4G2; Sanofi Pasteur) for protein detection via western blot and FACS. Experiments were performed according to Example 10. The constructs R3542 and R3548 were used as positive controls. WFI (water for injection) was used as negative control.

Results:

The expression of E protein from the DENV-1 C-P2A-SSc-prME (R3782) and DENV-2 C-P2A-SSc-prME (R3784) constructs was demonstrated in vitro by western blot and intracellular flow cytometry. Results of the in vitro experiments are shown in FIG. 16.

Example 14: Expression of DENV-3 E Protein Mutant Constructs in HeLa Cells and Mice In order to determine in vitro protein expression of the constructs R3558, R3567 and R3780, HeLa cells were transiently transfected with 1 µg and 2 µg formulated mRNA encoding DENV-3 E protein mutant constructs (R3552: DENV-3 SSc-prME; R3554: DENV-3 SSc-prMEdelstem_TM-JEV; R3558: DENV-3 SSc-prME(R186L); R3765: DENV-3 SSc-prME(F108S); R3780: DENV-3 SSc-prME(A265T)) and probed using a pan-flaviviral anti E protein antibody (4G2; Sanofi Pasteur) or sera of mice immunized with the DENV-3 prME construct collected two weeks post third immunization for protein detection via western blot on cell lysates, supernatants and VLP preparations. The constructs R3552 and R3554 were used as positive controls. WFI (water for injection) was used as negative control. Experiment was performed as previously described (e.g., Example 10).

Results:

The expression of DENV-3 E protein mutant constructs R3558, R3765 and R3780 was demonstrated in vitro by western blot. Results of the experiment are shown in FIG. 17.

Example 15: In Vitro Characterization of DENV-3 Constructs Expression in HeLa Cells by Western Blot In order to determine in vitro protein expression of DENV-3 constructsHeLa cells were transiently transfected with the respective amount of formulated mRNA indicated in Table 10 and probed using a pan-flaviviral anti E protein antibody (4G2; Sanofi Pasteur) for protein detection via western blot. R3552 and R3554 and R3556 served as positive controls, water for injection (WFI) as negative controls. Experiments were performed according to Example 10.

TABLE 10 mRNA constructs used in the experiment (Example 15)

| RNA ID | Further information | Amount transfected RNA | Sample |
|--------|---------------------|------------------------|--------|
| R3552 | DENV-3 SSc-prME | 2 µl | A |
| R3554 | DENV-3 SSc-prMEdelstem_TM-JEV | 2 µl | B |
| R3790 | DENV-3 SSc-prME-NS1 | 2.9 µl | C |
| R3792 | DENV-3 SSc-prME-NS1-[IRES]-NS3 | 4.9 µl | D |
| R3794 | DENV-3 NS3-[IRES]-SSc-prME-NS1 | 4.9 µl | E |
| R3804 | DENV-3 NS3 | 1.9 µl | F |
| R3556 | DENV-3 SSm-EdelTM | 1.4 µl | G |
| R3796 | DENV-3 SSm-EdelTM-linker-ferritin | 1.8 µl | H |
| R3798 | DENV-3 SSm-EdelTM-linker-ferritin-[IRES]-NS3 | 3.8 µl | I |
| R3800 | DENV-3 SStPA-WHbcAg-linker-EdelTM | 1.8 µl | J |
| R3802 | DENV-3 SStPA-WHbcAg-linker-EdelTM-[IRES]-NS3 | 3.8 µl | K |
| | water for injection | | L |
| | C6/36 VDV3 lysate | | M |

Results:

The expression of DENV-3 constructs could be detected for several constructs in cell lysates (R3790, R3792, R3794, R3796, R3800) and supernatants (R3790) by western blot. Results of the experiment are shown in FIG. 18.

Example 16: Immunization of Mice with DENV-3 prME Mutant Constructs and Detection of an Antigen-Specific Humoral Response Female BALB/c mice (n=10/group) were injected intradermal (i.d.) with 40 µg formulated mRNAs encoding DENV-3 SSc-prME (R3552), SSc-prME(R186L) (R3558), SSc-prME(F108S) (R3765), SSc-prME(A265T) (R3780) administered in a prime/boost/boost regimen on day 0, 21 and 42. RiLa buffer treated mice were used as control. DENV-3-specific IgG1 and IgG2a titers were determined on day 21, 42, 49 by ELISA using UV inactivated CYD3 viruses for coating according to experiments above. Results are shown in FIG. 19.

Results:

All groups immunized with the different DENV-3 E protein mutant constructs showed IgG1 and IgG2a titers above the RiLa buffer control levels. Moreover, animals immunized with prME(F108S) mutant construct (R3765) showed higher titers compared to the group vaccinated with DENV-3 prME construct (R3552) at day 21 and day 42 (see FIG. 19).

Example 17: Immunization of Mice with DENV2 C-P2A-SS-prME mRNA Constructs and Detection of E and C Protein Specific T-Cell Response (ICS by FACS Analysis)

Female Balb/c mice (n=10/group) were immunized i.d. with 40 µg of the respective formulated RNA encoding DENV-2 SS-prME-JEV or C-P2A-SSc-prME (R3548, R3784) administered in a prime/boost/boost regimen on day 0, 21 and 42. RiLa buffer treated mice were used as ctrl. T cell immune responses were measured by ICS upon re-stimulation of splenocytes (isolated on day 49 post prime) with a DENV-3 E protein or C protein specific peptide mix. ICS and FACS performed as described above.

Results: As shown in FIG. 20, DENV-2 C-P2A-SS-prME RNA induced E protein specific CD8+ T cell responses (see FIG. 20A), C-protein specific CD8+ T cell responses (see FIG. 20B) and C-protein specific CD4+ T cell responses (see FIG. 20C).

Example 18: Analysis of the Expression of DENV-3 Furin Cleavage Mutants

Hela cells were transfected using Lipofectamine2000 with 2 µg of the RNA constructs and used controls are listed in (see Table 11). 20-24h later cells were harvested and analyzed by FACS or western blot for the expression of the encoded antigen. Whole cell lysates were subjected to non-denaturing SDS-PAGE (4-20% gel) followed by western blot detection using human anti-DENV serum (allows assessment of prM cleavage and E protein expression) that was provided by Sanofi Pasteur (see FIG. 21). In order to determine the efficiency of furin cleavage of prME into prM and E, normalized signal intensities of the E protein and prM signal were determined using Image Studio software (Licor Biosciences). E/prM ratio was calculated using the following formula: (normalized E protein signal/normalized prM protein signal) ×1000 (see FIG. 22). Whole cell lysates, cell free supernatants and VLP preparations were subjected to non-reducing/non-denaturing SDS-PAGE (10% gel) followed by western blot detection using 4G2 antibody which binds to an epitope in the fusion loop of the E protein (provided by Sanofi Pasteur) as shown in FIG. 23. For flow cytometric analysis the cells were harvested using trypsin-free detach buffer and stained intracellularly with 4G2 antibody or 5C12 Ab which binds to an unknown epitope in the E protein (both provided by Sanofi Pasteur) followed by a secondary anti-mouse FITC-conjugated antibody. The cells were acquired on a BD FACS Canto and analyzed using FlowJo Software Version 10.6 (see FIG. 24).

TABLE 11

DENV-3 mRNA constructs used in the experiment (Example 18)

| RNA ID | Construct description | Sample |
|--------|----------------------|--------|
| R3552 | DENV-3 SSc-prME | A |
| R3554 | DENV-3 SSc-prMEdelstem_TM-JEV | B |
| R3558 | DENV-3 SSc-prME(R186L) | C |
| R3780 | DENV-3 SSc-prME(A265T) | D |
| R4450 | DENV-3 SSopt-prME(R186L), (A265T) | E |
| R4452 | DENV-3 SSopt-prMEdelstem_TM, (R186L), (A265T)-JEV | F |
| R4456 | DENV-3 SSopt-pr(D104A)MEdelstem_TM, (R186L), (A265T)-JEV | G |
| R3765 | DENV-3 SSc-prME(F108S) | H |
| R4458 | DENV-3 SSopt-prME(F108S) | I |
| R4460 | DENV-3 SSopt-pr(D104A)ME(F108S) | J |
| R4462 | DENV-3 SSopt-pr(D104A)MEdelstem_TM, (F108S)-JEV | K |
| R4466 | DENV-3 SSopt-pr(D104A)MEdelstem_TM, (F108S), (R186L), (A265T)-JEV | L |
| | water for injection | WFI |
| | C6/36 VDV3 lysate | VCV3 |

Results:

The expression of all tested DENV-3 constructs (see Table 11) was successfully demonstrated in vitro upon lipofection of Hela cells using either the 4G2 antibody, 5C12 antibody or human convalescent anti-DENV serum for detection of antigen expression (see FIG. 21-24). The constructs R4458, R4460, R4462, and R4466 which contain a mutation in the E protein fusion loop (F108S) showed only a weak signal in the FACS (see FIG. 24) and no signal in western blot when 4G2 antibody was used for detection (see FIG. 23). These observations could be explained with the specificity of the 4G2 antibody which binds to an epitope in the fusion loop of the E protein domain II. This epitope is either mutated or deleted in the above mentioned constructs. However, expression of the E protein was demonstrated for constructs R4458, R4460, R4462, and R4466 using the 5C12 antibody or human sera from a DENV convalescent individual (see FIG. 21 and FIG. 23). Compared to construct R3765 (SSc-prME(F108S)) constructs encoding either an optimized signal peptide (R4458, SSopt-prM-E(F108S)) or the D->A mutation at position P3 of the furin cleavage site (R4460, SSopt-pr(D104A)-ME(F108S)) showed an increased E/prM signal ratio in the western blot detected using anti-DENV IgG (see FIG. 22) indicating an improved furin cleavage for those constructs. The constructs R4452 and R4456 which encode the JEV stem in the C-terminal region of the E protein showed increased signal in the 4G2 Ab western blot analysis in the supernatant and VLP preparations compared to the respective constructs containing the original C-terminal region of the DENV-3 E protein (R4450) (see FIG. 23). These data suggest that the substitution of the DENV-3 C-terminal E protein region with the JEV stem leads to increased secretion of the E protein in form of VLPs.

Example 19: Analysis of the Expression of DENV-3 Pre-Fusion Conformation Mutants The experiments were essentially performed according to Example 18 using the constructs as indicated in Table 12.

TABLE 12

| DENV-3 mRNA constructs used in the experiment (Example 19) | | |
|---|---|---|
| RNA ID | Construct description | Sample |
| R3552 | DENV-3 SSc-prME | A |
| R3554 | DENV-3 SSc-prMEdelstem_TM-JEV | B |
| R3765 | DENV-3 SSc-prME(F108S) | C |
| R4490 | DENV-3 SSopt-prME(Y96H) | D |
| R4486 | DENV-3 SSopt-prME(T76I) | E |
| R4492 | DENV-3 SSopt-prME(K110E) | F |
| R4484 | DENV-3 SSopt-prME(S184F) | G |
| R4494 | DENV-3 SSopt-prME(N240S) | H |
| R4496 | DENV-3 SSopt-prME(M258L) | I |
| R4498 | DENV-3 SSopt-prME(S296G) | J |
| R4500 | DENV-3 SSopt-prME(S311R) | K |
| R4502 | DENV-3 SSopt-prME(K321T) | L |
| | water for injection | WFI |
| | C6/36 VDV3 lysate | VCV3 |

Results:
    The expression of all tested DENV-3 constructs (see Table 12) was successfully demonstrated in vitro upon lipofection of Hela cells using either the 4G2 antibody, 5C12 antibody or the human convalescent anti-DENV serum for detection of antigen expression (see FIG. 25-27).

Example 20: Analysis of the Expression of DENV-3 E Protein Fusion Loop Deletion and Protonable his Mutants The experiments were essentially performed according to Example 18 using the constructs as indicated in Table 13.

TABLE 13

| DENV-3 mRNA constructs used in the experiment (Example 20) | | |
|---|---|---|
| RNA ID | Construct description | Sample |
| R3552 | DENV-3 SSc-prME | A |
| R3554 | DENV-3 SSc-prMEdelstem_TM-JEV | B |
| R3765 | DENV-3 SSc-prME(F108S) | C |
| R4468 | DENV-3 SSopt-prMdel101-107, (R99P), (F108N) | D |
| R4470 | DENV-3 SSopt-prMEdelstem_TM, del101-107, (R99P), (F108N)-JEV | E |
| R4480 | DENV-3 SSopt-prME(G28C), (H242C) | F |
| R4472 | DENV-3 SSopt-prME(H27N) | G |
| R4474 | DENV-3 SSopt-prME(H259N) | H |
| R4476 | DENV-3 SSopt-prMEdelstem_TM, (H259N)-JEV | I |
| R4478 | DENV-3 SSopt-prME(H259R) | J |
| R4482 | DENV-3 SSopt-prME(H149N) | K |
| | water for injection | WFI |
| | C6/36 VDV3 lysate | VCV3 |

Results:
    The expression of all tested DENV-3 constructs (see Table 13) was successfully demonstrated in vitro upon lipofection of Hela cells using either the 4G2 antibody, 5C12 antibody or the human convalescent anti-DENV serum for detection of antigen expression (see FIGS. 28-30). Constructs R4468 and R4470 that contain a deletion of fusion loop showed neither a signal in the FACS nor in the western blot analysis using 4G2 antibody (see FIG. 29 and FIG. 30). These observations could be explained with the specificity of the 4G2 antibody which binds to an epitope in the fusion loop of the E protein domain II. This epitope is either mutated or deleted in the above mentioned constructs. However, expression of the E protein was demonstrated for constructs R4468 and R4470 (see FIG. 28) using the 5C12 Antibody or human sera from a DENV convalescent individual. The constructs R4476 which encode the JEV stem in the E-terminal region of the E protein showed increased signal in the 4G2 antibody western blot analysis in the supernatant and VLP preparations compared to the respective constructs containing the original C-terminal region of the DENV-3 E protein (R4474) as shown in FIG. 29. These data suggest that the substitution of the DENV-3 C-terminal region of the E protein with the JEV stem leads to increased secretion of the E protein in form of VLPs.

Example 21: Analysis of the Expression of DENV-3 Constructs with Optimized Signal Peptide and Further Pre-Fusion Stabilization Mutants The experiments were essentially performed according to Example 18 using the constructs as indicated in Table 14.

TABLE 14

| DENV-3 mRNA constructs used in the experiment (Example 21) | | |
|---|---|---|
| RNA ID | Construct description | Sample |
| R3552 | DENV-3 SSc-prME | A |
| R3554 | DENV-3 SSc-prMEdelstem_TM-JEV | B |
| R3558 | DENV-3 SSc-prME(R186L) | C |
| R4446 | DENV-3 SSopt-prME(R186L) | D |
| R3780 | DENV-3 SSc-prME(A265T) | E |
| R4448 | DENV-3 SSopt-prME(A265T) | F |
| R3765 | DENV-3 SSc-prME(F108S) | G |
| R4458 | DENV-3 SSopt-prME(F108S) | H |
| R4460 | DENV-3 SSopt-pr(D104A)ME(F108S) | I |
| R4492 | DENV-3 SSopt-prME(K110E) | J |
| R4488 | DENV-3 SSopt-prME(N89D) | K |
| | water for injection | WFI |
| | C6/36 VDV3 lysate | VCV3 |

Results:

The expression of all tested DENV-3 constructs (see Table 14) was successfully demonstrated in vitro upon lipofection of Hela cells using either the 4G2 antibody, 5C12 antibody or the human convalescent anti-DENV serum for detection of antigen expression (see FIG. 31-33).

Example 22: Analysis of the DENV-3 mRNA Constructs Encoding Pre-Fusion Mutant R186L and A265T Combinations The experiments were essentially performed according to Example 18 using the constructs as indicated in Table 15.

TABLE 15

| DENV-3 mRNA constructs used in the experiment (Example 22) | | |
|---|---|---|
| RNA ID | Construct description | Sample |
| R4454 | DENV-3 SSopt-pr(D104A)ME(R186L), (A265T) | J |
| R4456 | DENV-3 SSopt-pr(D104A)MEdelstem_TM, (R186L), (A265T)-JEV | K |
| R4464 | DENV-3 SSopt-pr(D104A)ME(F108S), (R186L), (A265T) | L |
| | water for injection | WFI |
| | C6/36 VDV3 lysate | VCV3 |

Results:

The expression of all tested DENV-3 constructs (see Table 15) was successfully demonstrated in vitro upon lipofection of Hela cells using either the 4G2 antibody, 5C12 antibody or the human convalescent anti-DENV serum for detection of antigen expression (see FIG. 34).

Example 23: Immunization of Hamster with DENV-3 Constructs and Detection of Antigen Specific Humoral Response Female Syrian golden hamsters (9 animals per group) were immunized three times on days 0, 21 and 35 by intradermal injection (id) of 80 µg of the different DENV-3 mRNAs (characterized in Examples 18-22), performed in different studies (see Table 16 (study 23A) Table 17 (study 23B) and Table 18 (study 23C)). Negative controls received ringer lactate buffer. As positive control, live CYD3 virus (chimeric virus containing DENV-3 prME in an YFV backbone, provided by Sanofi Pasteur) was used in study 23C (108 PFU). Analysis of humoral immune responses was performed in serum samples collected during the study (day 35 and day 52). Binding of DENV-3-specific IgG antibodies was analyzed by ELISA using UV inactivated CYD3 virus for coating during the study (indicated in respective tables). Binding of DENV-3-specific IgG antibodies was analyzed by ELISA using UV inactivated CYD3 virus for coating. Coated plates were incubated using respective serum dilutions, and binding of specific antibodies to the DENV antigens was detected using biotinylated isotype specific anti-hamster antibodies followed by streptavidin-HRP (horse radish peroxidase) with ABTS as substrate. The results of the ELISA analysis are shown in FIGS. 35-38.

TABLE 16

| Design of immunization experiment; study 23A | | |
|---|---|---|
| RNA ID | DENV-3 antigen | Route/volume |
| R3552 | SSc-prME | id; 2 × 50 µl |
| R4446 | SSopt-prME(R186L) | id; 2 × 50 µl |

TABLE 16-continued

| Design of immunization experiment; study 23A | | |
|---|---|---|
| RNA ID | DENV-3 antigen | Route/volume |
| R4448 | SSopt-prME(A265T) | id; 2 × 50 µl |
| R4450 | SSopt-prME(R186L), (A265T) | id; 2 × 50 µl |
| R4452 | SSopt-prMEdelstem_TM, (R186L), (A265T)-JEV | id; 2 × 50 µl |
| R4454 | SSopt-pr(D104A)ME(R186L), (A265T) | id; 2 × 50 µl |
| R4456 | SSopt-pr(D104A)MEdelstem_TM, (R186L), (A265T)-JEV | id; 2 × 50 µl |
| R4488 | SSopt-prME(N89D) | id; 2 × 50 µl |
| | RiLa buffer | id; 2 × 50 µl |

TABLE 17

| Design of immunization experiment; study 23B | | |
|---|---|---|
| RNA ID | DENV-3 antigen | Route/volume |
| R3552 | SSc-prME | id; 2 × 50 µl |
| R4472 | SSopt-prME(H27N) | id; 2 × 50µl |
| R4474 | SSopt-prME(H259N) | id; 2 × 50 µl |
| R4476 | SSopt-prMEdelstem_TM, (H259N)-JEV | id; 2 × 50 µl |
| R4478 | SSopt-prME(H259R) | id; 2 × 50 µl |
| | RiLa buffer | id; 2 × 50 µl |

TABLE 18

| Design of immunization experiment; study 23C | | |
|---|---|---|
| RNA ID | DENV-3 antigen | Route/volume |
| R3552 | cprME | id; 2 × 50 µl |
| R4458 | SSopt-prME(F108S) | id; 2 × 50 µl |
| R4460 | SSopt-pr(D104A)ME(F108S) | id; 2 × 50 µl |
| R4462 | SSopt-pr(D104A)MEdelstem_TM, (F108S)-JEV | id; 2 × 50 µl |
| R4464 | SSopt-pr(D104A)ME(F108S), R186L, (A265T) | id; 2 × 50 µl |
| R4466 | SSopt-pr(D104A)MEdelstem_TM, (F108S), (R186L), (A265T)-JEV | id; 2 × 50 µl |
| R4482 | SSopt-prME(H149N) | id; 2 × 50 µl |
| R4484 | SSopt-prME(S184F) | id; 2 × 50 µl |
| R4486 | SSopt-prME(T76I) | id; 2 × 50 µl |
| R4490 | SSopt-prME(Y96H) | id; 2 × 50 µl |
| R4492 | SSopt-prME(K110E) | id; 2 × 50 µl |
| R4494 | SSopt-prME(N240S) | id; 2 × 50 µl |
| R4496 | SSopt-prME(M258L) | id; 2 × 50 µl |
| R4498 | SSopt-prME(S296G) | id; 2 × 50 µl |
| R4500 | SSopt-prME(S311R) | id; 2 × 50 µl |
| R4502 | SSopt-prME(K321T) | id; 2 × 50 µl |
| | Live CYD3 | ip; 500 µl |
| | RiLa buffer | id; 2 × 50 µl |

Results:

As shown in FIGS. 35-38, assessment of the humoral immune response after immunizations revealed that the respective DENV-3 mRNAs tested in study 23A, 23B and 23C induced ELISA IgG antibody titers. In summary, the results show that the tested DENV-3 mRNAs induce a strong humoral immune response in hamster.

Example 24: Immunization of Hamster with DENV-3 Constructs and Detection of Virus Neutralizing Antibodies Female Syrian golden hamsters (9 animals per group) were immunized three times on days 0, 21 and 35 by intradermal injection of 80 µg of different DENV-3 mRNAs.

Negative controls received ringer lactate buffer. Blood samples were collected at certain time points during the study (as indicated in the design of the immunization experiment, shown in Table 19 and Table 20). Sera were analyzed by a plaque reduction neutralization test (PRNT50). Briefly, serum samples were incubated with DENV virus. The mixture was used to infect cultured cells, and the reduction in the number of plaques was determined. Results are shown in FIG. 39 and FIG. 40.

TABLE 19

Design of immunization experiment
for PRNT50 assay (Example 24)

| RNA ID | DENV-3 antigen | Route/ volume | Blood Samples [day] |
|---|---|---|---|
| R3552 | SSc-prME | i.d. 2 × 50 µl | 35, 52 |
| R4446 | SSopt-prME(R186L) | i.d. 2 × 50 µl | 35, 52 |
| R4452 | SSopt-prMEdelstem_TM, (R186L), (A265T)-JEV | i.d. 2 × 50 µl | 35, 52 |
| R4456 | SSopt-pr(D104A)MEdelstem_TM, (R186L), (A265T)-JEV | i.d. 2 × 50 µl | 35, 52 |
| R4476 | SSopt-prMEdelstem_TM, (H259N)-JEV | i.d. 2 × 50 µl | 35, 52 |
| R4478 | SSopt-prME(H259R) | i.d. 2 × 50 µl | 35, 52 |
|  | RiLa buffer | i.d. 2 × 50 µl | 35, 52 |

TABLE 20

Design of immunization experiment
for PRNT50 assay (Example 24)

| RNA ID | DENV-3 antigen | Route/ volume | Blood Samples [day] |
|---|---|---|---|
| R4458 | SSopt-prME(F108S) | i.d. 2 × 50 µl | 35, 52 |
| R4462 | SSopt-pr(D104A)MEdelstem_TM, (F108S)-JEV | i.d. 2 × 50 µl | 35, 52 |
| R4484 | SSopt-prME(S184F) | i.d. 2 × 50 µl | 35, 52 |
| R4490 | SSopt-prME(Y96H) | i.d. 2 × 50 µl | 35, 52 |
| R4494 | SSopt-prME(N240S) | i.d. 2 × 50 µl | 35, 52 |
| R4502 | SSopt-prME(K321T) | i.d. 2 × 50 µl | 35, 52 |
|  | RiLa buffer | i.d. 2 × 50 µl | 35, 52 |

Results:

The results of the experiment show that neutralizing antibodies, as indicated by the PRNT50 titer>20 (dashed horizontal line in FIG. 39 and FIG. 40), were induced after immunization with the DENV-3 mRNA constructs.

Neutralizing antibodies, as indicated by the PRNT50 titer 20 (dashed horizontal line in FIG. 39), were detected on day 35 and day 52 in serum of individual hamster vaccinated with the DENV-3 mRNA constructs. In all vaccinated groups (R3552, R4446, R4452, R4456, R4476, R4458, R4462, R4484, R4490, R4494, R4500, R4502), the geometric mean titer (indicated by a horizontal line) was ≥20 after the third immunization. In the groups vaccinated with R4446, R4476, R4462, and R4490 already after the second immunization geometric mean titer≥20 were observed.

Example 25: Immunization of NHPs with Different Formulations and Application Routes The study was carried out in cynomolgus monkeys of Vietnamese origin with mRNA vaccines encoding YFV X-SS-prME-XX antigen.

The design of study I is summarized in Table 21. Each group contained 4 animals (2 male and 2 female). Group1 received protamine-formulated YFV mRNA vaccine R2582/R3912 applied via the intradermal route using a needle-free Tropis JET device. Animals were immunized three times (days 0, 28 and 56). Group2 received protamine-formulated YFV mRNA vaccine R2582/R3912 applied via the intradermal route using a needle-free Tropis JET device. Animals were immunized on days 0 and 28. For each group, blood samples were collected on days 0 (pre-dose), 28, 56, 78 and 99 for assessment of YFV-specific immune responses (PRNT assay, ELISA, see FIGS. 41 and 42). T-cell immune responses were analyzed on peripheral mononuclear cells (PBMCs) isolated on days 0, 14, 42 and 63 of the study (see FIG. 43).

TABLE 21

Design of immunization study I (Example 25)

| group | YFV antigen | RNA ID | formulation | dose | route/ application/volume | Immunization schedule |
|---|---|---|---|---|---|---|
| 1 | X-SS-prME-XX | R2582/R3912 | protamine Tropis JET | 80 µg | i. d., Tropis JET 1 × 100 µl | 0/28/56 |
| 2 | X-SS-prME-XX | R2582/R3912 | protamine Tropis JET | 80 µg | i. d., Tropis JET 1 × 100 µl | 0/28 |

Results:
The results show that both, antigen-specific humoral und antigen-specific cellular immune responses could be induced upon administration of the tested protamine formulated YFV mRNA vaccines after i.d. administration. Notably, the results also show two (as performed in group 2) immunizations were sufficient to induce humoral and cellular immune responses, including neutralizing antibody titers.

Example 26: Immunization of NHPs with Polymer-Lipidoid Formulated YFV mRNA

The studies were carried out in cynomolgus monkeys of Vietnamese origin using polymer-lipidoid formulated mRNA vaccines (YFV X-SS-prME-XX antigen).
Study I:
The aim of the experiment was to investigate whether humoral and/or cellular immune responses can be induced using a polymer-lipidoid-based formulation after intramuscular application. The design of study I is summarized in Table 22. The group contained 4 animals (2 male and 2 female). Animals received a polymer-lipidoid formulated YFV mRNA vaccine R3911 applied via the intramuscular route using conventional needle-based injection. Animals were immunized on days 0 and 28. Blood samples were collected on days 0 (pre-dose), 28, 56, 78 and 99 for assessment of YFV-specific humoral immune responses (ELISA, PRNT assay). The results of the ELISA and PRNT assay are shown in FIG. 44 and FIG. 45. T-cell immune responses was performed on peripheral mononuclear cells (PBMCs) isolated on days 0, 14, 42 and 63 of the study (see FIG. 46).

TABLE 22

| | | | | | route/ | Immunization |
| group | YFV antigen | RNA ID | formulation | dose | application/volume | schedule |
|---|---|---|---|---|---|---|
| | Design of immunization study I (Example 26) | | | | | |
| 1 | X-SS-prME-XX | R3911 | Polymer-lipidoid | 100 µg | i.m., needle, 1 × 500 µl | 0/28 |

Study II:

The aim of this study was to investigate whether a dose increase of the polymer-lipidoid formulated YFV mRNA vaccine R3911 could improve the PRNT titers. The group contained 4 animals (2 male and 2 female). Animals were treated with a polymer-lipidoid formulated YFV mRNA vaccine R3911 applied via the intramuscular route using conventional needle-based injection. Animals were immunized on days 0 and 28. Blood samples were collected on days 0 (pre-dose), 28, 56, 78 and 99 for assessment of YFV-specific immune responses (ELISA titers, PRNT assay). The results of the ELISA assay are shown in FIG. 47. The results of the PRNT assay are shown in FIG. 48.

TABLE 23

| | | | | | route/ | Immunization |
| group | YFV antigen | RNA ID | formulation | dose | application/volume | schedule |
|---|---|---|---|---|---|---|
| | Design of immunization study II (Example 26) | | | | | |
| 1 | X-SS-prME-XX | R3911 | Polymer-lipidoid | 200 µg | i.m., needle, 1 × 500 µl | 0/28 |

Results:

The results shows that both, antigen-specific humoral und antigen-specific cellular immune responses could be induced upon administration of the polymer-lipidoid formulated YFV mRNA vaccine. Notably, the polymer-lipidoid formulated YFV mRNA vaccine induced significant immune responses upon intramuscular administration, including strong neutralizing antibody titers (see e.g. FIG. 48).

SEQUENCE LISTING (26361 sequences)

SEQ ID NO: 1 - DNA, 42 bp, synthetic construct
  misc_feature 1..42: note = 5'-UTR of human ribosomal protein Large 32 lacking the 5' terminal oligopyrimidine tract
  source 1..42: mol_type = other DNA
ggcgctgcctacggaggtggcagccatctccttctcggcatc

SEQ ID NO: 2 - RNA, 42 nt, synthetic construct
  misc_feature 1..42: note = 5'-UTR of human ribosomal protein Large 32 lacking the 5' terminal oligopyrimidine tract mRNA
  source 1..42: mol_type = other RNA
ggcgctgcctacggaggtggcagccatctccttctcggcatc

SEQ ID NO: 3 - DNA, 110 bp, synthetic construct
  misc_feature 1..110: note = 3'-UTR of Homo sapiens hemoglobin, alpha 1 (HBA1)
  source 1..110: mol_type = other DNA
gctggagcctcggtggccatgcttcttgccccttgggcctccccccagcccctcctccccttcctgcacccgtacccccgtggtctttgaataaagtctgagtgggcggc

SEQ ID NO: 4 - RNA, 110 nt, synthetic construct
  misc_feature 1..110: note = 3'-UTR of Homo sapiens hemoglobin, alpha 1 (HBA1) mRNA
  source 1..110: mol_type = other RNA
gctggagcctcggtggccatgcttcttgccccttgggcctccccccagcccctcctccccttcctgcacccgtacccccgtggtctttgaataaagtctgagtgggcggc

SEQ ID NO: 5 - DNA, 108 bp, synthetic construct
  misc_feature 1..108: note = 3'-UTR of Homo sapiens hemoglobin, alpha 2 (HBA2)
  source 1..108: mol_type = other DNA
gctggagcctcggtagccgttcctcctgcccgctgggcctcccaacgggccctcctcccctccttgcaccggcccttcctggtctttgaataaagtctgagtgggcag

SEQ ID NO: 6 - RNA, 108 nt, synthetic construct
  misc_feature 1..108: note = 3'-UTR of Homo sapiens hemoglobin, alpha 2 (HBA2) mRNA
  source 1..108: mol_type = other RNA
gctggagcctcggtagccgttcctcctgcccgctgggcctcccaacgggccctcctcccctccttgcaccggcccttcctggtctttgaataaagtctgagtgggcag

SEQ ID NO: 7 - DNA, 132 bp, synthetic construct
  misc_feature 1..132: note = 3'-UTR of Homo sapiens hemoglobin, beta (HBB)
  source 1..132: mol_type = other DNA
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 8 - RNA, 132 nt, synthetic construct
  misc_feature 1..132: note = 3'-UTR of Homo sapiens hemoglobin, beta (HBB) mRNA
  source 1..132: mol_type = other RNA
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 9 - DNA, 44 bp, synthetic construct
  misc_feature 1..44: note = Center, alpha-complex-binding portion of the 3'UTR of an alpha-globin gene (muag)
  source 1..44: mol_type = other DNA
gcccgatgggcctcccaacgggccctcctcccctccttgcaccg

SEQ ID NO: 10 - RNA, 44 nt, synthetic construct
  misc_feature 1..44: note = Center, alpha-complex-binding portion of the 3'UTR of an alpha-globin gene (muag) mRNA
  source 1..44: mol_type = other RNA
gcccgatgggcctcccaacgggccctcctcccctccttgcaccg

SEQ ID NO: 11 - DNA, 186 bp, synthetic construct
  misc_feature 1..186: note = 3'-UTR of human albumin
  source 1..186: mol_type = other DNA
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 12 - RNA, 186 nt, synthetic construct
  misc_feature 1..186: note = 3'-UTR of human albumin mRNA
  source 1..186: mol_type = other RNA
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 13 - DNA, 186 bp, synthetic construct
  misc_feature 1..186: note = 3'-UTR albumin7
  source 1..186: mol_type = other DNA
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 14 - RNA, 186 nt, synthetic construct
  misc_feature 1..186: note = 3'-UTR albumin7 mRNA
  source 1..186: mol_type = other RNA
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 15 - DNA, 187 bp, synthetic construct
  misc_feature 1..187: note = 3'-UTR ALB7
  source 1..187: mol_type = other DNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 16 - RNA, 187 nt, synthetic construct
  misc_feature 1..187: note = 3'-UTR ALB7 mRNA
  source 1..187: mol_type = other RNA
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 17 - DNA, 24 bp, synthetic construct
  misc_feature 1..24: note = histone stem-loop sequence
  source 1..24: mol_type = other DNA
caaaggctcttttcagagccacca

SEQ ID NO: 18 - RNA, 24 nt, synthetic construct
  misc_feature 1..24: note = histone stem-loop sequence mRNA
  source 1..24: mol_type = other RNA
caaaggctcttttcagagccacca

SEQ ID NO: 19 - DNA, 13 bp, synthetic construct
  misc_feature 1..13: note = Kozak
  source 1..13: mol_type = other DNA
gccgccaccatgg

SEQ ID NO: 20 - RNA, 13 nt, synthetic construct
  misc_feature 1..13: note = Kozak mRNA
  source 1..13: mol_type = other RNA
gccgccaccatgg

SEQ ID NO: 21 - RNA, 1870 nt, synthetic construct
  misc_feature 1..1870: note = mRNA product Design1 from modified/optimized Photinus pyralis__luciferase R1265/R2569
  source 1..1870: mol_type = other RNA
gggagaaagcttgaggatggaggacgccaagaacatcaagaagggcccggcgcccttctacccgctggaggacgggaccgccggcgagcagctccacaaggccatgaagcggtacgccctggtgccgggcacgatcgccttcaccgacgcccacatcgaggtcgacatcacctacgcggagtacttcgagatgagcgtgcgcctggccgaggccatgaagcggtacggcctgaacaccaaccaccggatcgtggtgtgctcggagaacagcctgcagttcttcatgccggtgctgggcgccctcttcatcggcgtggccgtcgccccggcgaacgacatctacaacgagcgggagctgctgaacagcatggggatcagccagccgaccgtggtgttcgtgagcaagaagggcctgcagaagatcctgaacgtgcagaagaagctgcccatcatccagaagatcatcatcatggacagcaagaccgactaccagggcttccagtcgatgtacacgttcgtgaccagccacctcccgccgggcttcaacgagtacgacttcgtcccggagagcttcgaccgggacaagaccatcgccctgatcatgaacagcagcggcagcaccggcctgccgaagggggtggccctgccgcaccggaccgcctgcgtgcgcttctcgcacgcccgggaccccatcttcggcaaccagatcatcccggacaccgccatcctgagcgtggtgccgttccaccacggcttcggcatgttcacgaccctgggctacctcatctgcggcttccgggtggtcctgatgtaccggttcgaggaggagctgttcctgcggagcctgcaggactacaagatccagagcgcgctgctcgtgccgaccctgttcagcttcttcgccaagagcaccctgatcgacaagtacgacctgtcgaacctgcacgagatcgccagcgggggcgccccgctgagcaaggaggtgggcgaggccgtggccaagcggttccacctcccgggcatccgccagggctacggcctgaccgagaccacgagcgcgatcctgatcacccccgagggggacgacaagccgggcgccgtgggcaaggtggtcccgttcttcgaggccaaggtggtggacctggacaccggcaagaccctgggcgtgaaccagcggggcgagctgtgcgtgcgggggccgatgatcatgagcggctacgtgaacaacccggaggccaccaacgccctcatcgacaaggacggctggctgcacagcggcgacatcgcctactgggacgaggacgagcacttcttcatcgtcgaccggctgaagtcgctgatcaagtacaagggctaccaggtggcgccggccgagctggagagcatcctgctccagcaccccaacatcttcgacgccggcgtggccgggctgccggacgacgacgccggcgagctgccggccgcggtggtggtgctggagcacggcaagaccatgacggagaaggagatcgtcgactacgtggccagccaggtgaccaccgccaagaagctgcggggcggcgtggtgttcgtggacgaggtcccgaagggcctgaccgggaagctcgacgcccggaagatccgcgagatcctgatcaaggccaagaagggcggcaagatcgccgtgtaagactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 22 - RNA, 1918 nt, synthetic construct
  misc_feature 1..1918: note = mRNA product Design1 from modified/optimized H1N1/A/Netherlands/602/2009__hemagglutinin R1548
  source 1..1918: mol_type = other RNA
gggagaaagcttaccatgaaggccatcctggtggtcctcctgtacaccttcgccaccgcgaacgccgacacgctgtgcatcggctaccacgccaacaacagcaccgacaccgtggacaccgtgctcgagaagaacgtcacggtgacccactccgtgaacctgctggaggacaagcacaacgggaagctctgcaagctgcggggcgtcgccccgctgcacctcgggaagtgcaacatcgccggctggatcctggggaacccggagtgcgagagcctgtccaccgcgagctcctggagctacatcgtggagacctccagctccgacaacggcacgtgctaccccggcgacttcatcgactacgaggagctccgcgagcagctgagctccgtgagctccttcgagcggttcgagatcttccccaagaccagctcctggcccaaccacgacagcaacaagggggtcaccgccgcctgcccgcacgccggcgcgaagtccttctacaagaacctgatctggctcgtgaagaaggggaacagctaccccaagctgtccaagagctacatcaacgacaagggcaaggaggtgctggtcctctgggggatccaccaccccagcacctccgccgaccagcagagcctgtaccagaacgccgacgcctacgtgttcgtgggctccagccgctactccaagaagttcaagcccgagatcgccatccggccgaaggtccgcgaccaggagggccggatgaactactactggacgctggtggagcccggggacaagatcaccttcgaggcgaccggcaacctcgtggtcccccgctacgccttcgccatggagcggaacgccgggagcggcatcatcatctccgacacccccgtgcacgactgcaacacgacctgccagaccccgaagggcgccatcaacaccagcctgcccttccagaacatccaccccatcacgatcgggaagtgccccaagtacgtgaagtccaccaagctgcgcctcgcgaccggcctgcggaacgtcccgagcatccagtcccgcgggctgttcggcgccatcgccgggttcatcgagggcggctggaccgggatggtggacggctggtacgggtaccaccaccagaacgagcagggcagcgggtacgccgccgacctcaagtccacgcagaacgcgatcgacgagatcaccaacaaggtgaacagcgtcatcgagaagatgaacacccagttcaccgccgtgggcaaggagttcaaccacctggagaagcggatcgagaacctgaacaagaaggtcgacgacggcttcctcgacatctggacgtacaacgccgagctgctggtgctcctggagaacgagcgcaccctggactaccacgactccaacgtgaagaacctctacgagaaggtccggagccagctgaagaacaacgccaaggagatcgggaacggctgcttcgagttctaccacaagtgcgacaacacctgcatggagtccgtgaagaacgggacctacgactaccccaagtacagcgaggaggccaagctgaaccgcgaggagatcgacggcgtgaagctcgagtccacgcggatctaccagatcctggcgatctacagcaccgtcgccagctccctggtgctcgtggtcagcctgggggccatctccttctggatgtgcagcaacggctccctgcagtgccgcatctgcatctgaccactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 23 - protein, 3411 aa, synthetic construct
  REGION 1..3411: note = derived and/or modified protein sequence (wt) from YFV 17D__NC_002031.1__polyprotein
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTAGEIHAVPFGLVSMMIAMEVVLRKRQGPKQMLVGGVVLLGAMLVGQVTLLDLLKLTVAVGLHFHEMNNGGDAMYMALIAAFSIRPGLLIGFGLRTLWSPRERLVLTLGAAMVEIALGGVMGGLWKYLNAVSLCILTINAVASRKASNTILPLMALLTPVTMAEVRLAAMFFCAVVIIGVLHQNFKDTSMQKTIPLVALTLTSYLGLTQPFLGLCAFLATRIFGRRSIPVNEALAAAGLVGVLAGLAFQEMENFLGPIAVGGLLMMLVSVAGRVDGLELKKLGEVSWEEEAEISGSSARYDVALSEQGEFKLLSEEKVPWDQVVMTSLALVGAALHPFALLLVLAGWLFHVRGARRSGDVLWDIPTPKIIEECEHLEDGIYGIFQSTFLGASQRGVGVAQGGVFHTMWHVTRGAFLVRNGKKLIPSWASVKEDLVAYGGSWKLEGRWDGEEEVQLIAAVPGKNVVNVQTKPSLFKVRNGGEIGAVALDYPSGTSGSPIVNRNGEVIGLYGNGILVGDNSFVSAISQTEVKEEGKEELQEIPTMLKKGMTTVLDFHPGAGKTRRFLPQILAECARRRLRTLVLAPTRVVLSEMKEAFHGLDVKFHTQAFSAHGSGREVIDAMCHATLTYRMLEPTRVVNWEVIIMDEAHFLDPASIAARGWAAHRARANESATILMTATPPGTSDEFPHSNGEIEDVQTDIPSEPWNTGHDWILADKRPTAWFLPSIRAANVMAASLRKAGKSVVVLNRKTFEREYPTIKQKKPDFILATDIAEMGANLCVERVLDCRTAFKPVLVDEGRKVAIKGPLRISASSAAQRRGRIGRNPNRDGDSYYYSEPTSENNAHHVCWLEASMLLDNMEVRGGMVAPLYGVEGTKTPVSPGEMRLRDDQRKVFRELVRNCDLPVWLSWQVAKAGLKTNDRKWCFEGPEEHEILNDSGETVKCRAPGGAKKPLRPRWCDERVSSDQSALSEFIKFAEGRRGAAEVLVVLSELPDFLAKKGGEAMDTISVFLHSEEGSRAYRNALSMMPEAMTIVMLFILAGLLTSGMVIFFMSPKGISRMSMAMGTMAGCGYLMFLGGVKPTHISYVMLIFFVLMVVVIPEPGQQRSIQDNQVAYLIIGILTLVSAVAANELGMLEKTKEDLFGKKNLIPSSASPWSWPDLDLKPGAAWTVYVGIVTMLSPMLHHWIKVEYGNLSLSGIAQSASVLSFMDKGIPFMKMNISVIMLLVSGWNSITVMPLLCGIGCAMLHWSLILPGIKAQQSKLAQRRVFHGVAENPVVDGNPTVDIEEAPEMPALYEKKLALYLLLALSLASVAMCRTPFSLAEGIVLASAALGPLIEGNTSLLWNGPMAVSMTGVMRGNHYAFVGVMYNLWKMKTGRRGSANGKTLGEVWKRELNLLDKRQFELYKRTDIVEVDRDTARRHLAEGKVDTGVAVSRGTAKLRWFHERGYVKLEGRVIDLGCGRGGWCYYAAAQKEVSGVKGFTLGRDGHEKPMNVQSLGWNIITFKDKTDIHRLEPVKCDTLLCDIGESSSSSVTEGERTVRVLDTVEKWLACGVDNFCVKVLAPYMPDVLEKLELLQRRFGGTVIRNPLSRNSTHEMYYVSGARSNVTFTVNQTSRLLMRRMRRPTGKVTLEADVILPIGTRSVETDKGPLDKEAIEERVERIKSEYMTSWFYDNDNPYRTWHYCGSYVTKTSGSAASMVNGVIKILTYPWDRIEEVTRMAMTDTTPFGQQRVFKEKVDTRAKDPPAGTRKIMKVVNRWLFRHLAREKNPRLCTKEEFIAKVRSHAAIGAYLEEQEQWKTANEAVQDPKFWELVDEERKLHQQGRCRTCVYNMMGKREKKLSEFGKAKGSRAIWYMWLGARYLEFEALGFLNEDHWASRENSGGGVEGIGLQYLGYVIRDLAAMDGGGFYADDTAGWDTRITEADLDDEQEILNYMSPHHKKLAQAVMEMTYKNKVVKVLRPAPGGKAYMDVISRRDQRGSGQVVTYALNTITNLKVQLIRMAEAEMVIHHQHVQDCDESVLTRLEAWLTEHGCDRLKRMAVSGDDCVVRPIDDRFGLALSHLNAMSKVRKDISEWQPSKGWNDWENVPFCSHHFHELQLKDGRRIVVPCREQDELIGRGRVSPGNGWMIKETACLSKAYANMWSLMYFHKRDMRLLSLAVSSAVPTSWVPQGRTTWSIHGKGEWMTTEDMLEVWNRVWITNNPHMQDKTMVKKWRDVPYLTKRQDKLCGSLIGMTNRATWASHIHLVIHRIRTLIGQEKYTDYLTVMDRYSVDADLQLGELI

SEQ ID NO: 24 - protein, 101 aa, synthetic construct
  REGION 1..101: note = derived and/or modified protein sequence (wt) from YFV 17D__NC_002031.1__C
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRR

SEQ ID NO: 25 - protein, 121 aa, synthetic construct
  REGION 1..121: note = derived and/or modified protein sequence (wt) from YFV 17D__NC_002031.1__C-ER anchor
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRRSHDVLTVQFLILGMLLMTGG

SEQ ID NO: 26 - protein, 89 aa, synthetic construct
  REGION 1..89: note = derived and/or modified protein sequence (wt) from YFV 17D__NC_002031.1__pr
VTLVRKNRWLLLNVTSEDLGKTFSVGTGNCTTNILEAKYWCPDSMEYNCPNLSPREEPDDIDCWCYGVENVRVAYGKCDSAGRSRRSRR

SEQ ID NO: 27 - protein, 75 aa, synthetic construct
  REGION 1..75: note = derived and/or modified protein sequence (wt) from YFV 17D__NC_002031.1__M
AIDLPTHENHGLKTRQEKWMTGRMGERQLQKIERWFVRNPFFAVTALTIAYLVGSNMTQRVVIALLVLAVGPAYS

SEQ ID NO: 28 - protein, 164 aa, synthetic construct
  REGION 1..164: note = derived and/or modified protein sequence (wt) from YFV 17D__NC_002031.1__prM
VTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYS

SEQ ID NO: 29 - protein, 493 aa, synthetic construct
  REGION 1..493: note = derived and/or modified protein sequence (wt) from YFV 17D__NC_002031.1__E
AHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 30 - protein, 657 aa, synthetic construct
  REGION 1..657: note = derived and/or modified protein sequence (wt) from YFV 17D__NC_002031.1__prME
VTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 31 - protein, 677 aa, synthetic construct
  REGION 1..677: note = derived and/or modified protein sequence (wt) from YFV 17D__NC_002031.1__ER anchor-prME
SHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 32 - protein, 352 aa, synthetic construct
  REGION 1..352: note = derived and/or modified protein sequence (wt) from YFV 17D__NC_002031.1__NS1
DQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTA

SEQ ID NO: 33 - protein, 224 aa, synthetic construct
  REGION 1..224: note = derived and/or modified protein sequence (wt) from YFV 17D__NC_002031.1__NS2A
GEIHAVPFGLVSMMIAMEVVLRKRQGPKQMLVGGVVLLGAMLVGQVTLLDLLKLTVAVGLHFHEMNNGGDAMYMALIAAFSIRPGLLIGFGLRTLWSPRERLVLTLGAAMVEIALGGVMGGLWKYLNAVSLCILTINAVASRKASNTILPLMALLTPVTMAEVRLAAMFFCAVVIIGVLHQNFKDTSMQKTIPLVALTLTSYLGLTQPFLGLCAFLATRIFGRR

SEQ ID NO: 34 - protein, 130 aa, synthetic construct
  REGION 1..130: note = derived and/or modified protein sequence (wt) from YFV 17D__NC_002031.1__NS2B
SIPVNEALAAAGLVGVLAGLAFQEMENFLGPIAVGGLLMMLVSVAGRVDGLELKKLGEVSWEEEAEISGSSARYDVALSEQGEFKLLSEEKVPWDQVVMTSLALVGAALHPFALLLVLAGWLFHVRGARR

SEQ ID NO: 35 - protein, 623 aa, synthetic construct
  REGION 1..623: note = derived and/or modified protein sequence (wt) from YFV 17D__NC_002031.1__NS3
SGDVLWDIPTPKIIEECEHLEDGIYGIFQSTFLGASQRGVGVAQGGVFHTMWHVTRGAFLVRNGKKLIPSWASVKEDLVAYGGSWKLEGRWDGEEEVQLIAAVPGKNVVNVQTKPSLFKVRNGGEIGAVALDYPSGTSGSPIVNRNGEVIGLYGNGILVGDNSFVSAISQTEVKEEGKEELQEIPTMLKKGMTTVLDFHPGAGKTRRFLPQILAECARRRLRTLVLAPTRVVLSEMKEAFHGLDVKFHTQAFSAHGSGREVIDAMCHATLTYRMLEPTRVVNWEVIIMDEAHFLDPASIAARGWAAHRARANESATILMTATPPGTSDEFPHSNGEIEDVQTDIPSEPWNTGHDWILADKRPTAWFLPSIRAANVMAASLRKAGKSVVVLNRKTFEREYPTIKQKKPDFILATDIAEMGANLCVERVLDCRTAFKPVLVDEGRKVAIKGPLRISASSAAQRRGRIGRNPNRDGDSYYYSEPTSENNAHHVCWLEASMLLDNMEVRGGMVAPLYGVEGTKTPVSPGEMRLRDDQRKVFRELVRNCDLPVWLSWQVAKAGLKTNDRKWCFEGPEEHEILNDSGETVKCRAPGGAKKPLRPRWCDERVSSDQSALSEFIKFAEGRR

SEQ ID NO: 36 - protein, 149 aa, synthetic construct
  REGION 1..149: note = derived and/or modified protein sequence (wt) from YFV 17D__NC_002031.1__NS4A-P2K
GAAEVLVVLSELPDFLAKKGGEAMDTISVFLHSEEGSRAYRNALSMMPEAMTIVMLFILAGLLTSGMVIFFMSPKGISRMSMAMGTMAGCGYLMFLGGVKPTHISYVMLIFFVLMVVVIPEPGQQRSIQDNQVAYLIIGILTLVSAVAA

SEQ ID NO: 37 - protein, 250 aa, synthetic construct
  REGION 1..250: note = derived and/or modified protein sequence (wt) from YFV 17D__NC_002031.1__NS4B
NELGMLEKTKEDLFGKKNLIPSSASPWSWPDLDLKPGAAWTVYVGIVTMLSPMLHHWIKVEYGNLSLSGIAQSASVLSFMDKGIPFMKMNISVIMLLVSGWNSITVMPLLCGIGCAMLHWSLILPGIKAQQSKLAQRRVFHGVAENPVVDGNPTVDIEEAPEMPALYEKKLALYLLLALSLASVAMCRTPFSLAEGIVLASAALGPLIEGNTSLLWNGPMAVSMTGVMRGNHYAFVGVMYNLWKMKTGRR

SEQ ID NO: 38 - protein, 905 aa, synthetic construct
  REGION 1..905: note = derived and/or modified protein sequence (wt) from YFV 17D__NC_002031.1__NS5
GSANGKTLGEVWKRELNLLDKRQFELYKRTDIVEVDRDTARRHLAEGKVDTGVAVSRGTAKLRWFHERGYVKLEGRVIDLGCGRGGWCYYAAAQKEVSGVKGFTLGRDGHEKPMNVQSLGWNIITFKDKTDIHRLEPVKCDTLLCDIGESSSSSVTEGERTVRVLDTVEKWLACGVDNFCVKVLAPYMPDVLEKLELLQRRFGGTVIRNPLSRNSTHEMYYVSGARSNVTFTVNQTSRLLMRRMRRPTGKVTLEADVILPIGTRSVETDKGPLDKEAIEERVERIKSEYMTSWFYDNDNPYRTWHYCGSYVTKTSGSAASMVNGVIKILTYPWDRIEEVTRMAMTDTTPFGQQRVFKEKVDTRAKDPPAGTRKIMKVVNRWLFRHLAREKNPRLCTKEEFIAKVRSHAAIGAYLEEQEQWKTANEAVQDPKFWELVDEERKLHQQGRCRTCVYNMMGKREKKLSEFGKAKGSRAIWYMWLGARYLEFEALGFLNEDHWASRENSGGGVEGIGLQYLGYVIRDLAAMDGGGFYADDTAGWDTRITEADLDDEQEILNYMSPHHKKLAQAVMEMTYKNKVVKVLRPAPGGKAYMDVISRRDQRGSGQVVTYALNTITNLKVQLIRMAEAEMVIHHQHVQDCDESVLTRLEAWLTEHGCDRLKRMAVSGDDCVVRPIDDRFGLALSHLNAMSKVRKDISEWQPSKGWNDWENVPFCSHHFHELQLKDGRRIVVPCREQDELIGRGRVSPGNGWMIKETACLSKAYANMWSLMYFHKRDMRLLSLAVSSAVPTSWVPQGRTTWSIHGKGEWMTTEDMLEVWNRVWITNNPHMQDKTMVKKWRDVPYLTKRQDKLCGSLIGMTNRATWASHIHLVIHRIRTLIGQEKYTDYLTVMDRYSVDADLQLGELI

SEQ ID NO: 39 - protein, 778 aa, synthetic construct
  REGION 1..778: note = derived and/or modified protein sequence (wt) from YFV 17D__NC_002031.1__C-prME
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 40 - protein, 1130 aa, synthetic construct
  REGION 1..1130: note = derived and/or modified protein sequence (wt) from YFV 17D__NC_002031.1__C-prME-NS1
MSGRKAQGKTLGVNMVRRGVRSLSNKIKQKTKQIGNRPGPSRGVQGFIFFFLFNILTGKKITAHLKRLWKMLDPRQGLAVLRKVKRVVASLMRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTA

SEQ ID NO: 41 - protein, 10 aa, synthetic construct
  REGION 1..10: note = derived and/or modified protein sequence (wt) from YFV 17D__NC_002031.1__X or 10aa (5'-terminus)
MRGLSSRKRR

SEQ ID NO: 42 - protein, 20 aa, synthetic construct
  REGION 1..20: note = derived and/or modified protein sequence (wt) from YFV 17D__NC_002031.1__SS or ER anchor (v1)
SHDVLTVQFLILGMLLMTGG

SEQ ID NO: 43 - protein, 18 aa, synthetic construct
  REGION 1..18: note = derived and/or modified protein sequence (wt) from YFV 17D__NC_002031.1__SS or ER anchor (v2)
DVLTVQFLILGMLLMTGG

SEQ ID NO: 44 - protein, 24 aa, synthetic construct
  REGION 1..24: note = derived and/or modified protein sequence (wt) from YFV 17D__NC_002031.1__SS or ER anchor (v4)
SHDVLTVQFLILGMLLMTGGVTLV

SEQ ID NO: 45 - protein, 30 aa, synthetic construct
  REGION 1..30: note = derived and/or modified protein sequence (wt) from YFV 17D__NC_002031.1__X-SS or 10aa (5'-terminus)-SS (v1)
MRGLSSRKRRSHDVLTVQFLILGMLLMTGG

SEQ ID NO: 46 - protein, 34 aa, synthetic construct
  REGION 1..34: note = derived and/or modified protein sequence (wt) from YFV 17D__NC_002031.1__X-SS or 10aa (5'-terminus)-SS (v2)
MRGLSSRKRRSHDVLTVQFLILGMLLMTGGVTLV

SEQ ID NO: 47 - protein, 10 aa, synthetic construct
  REGION 1..10: note = derived and/or modified protein sequence (wt) from YFV 17D__NC_002031.1__XX or 10aa (3'-terminus)
DQGCAINFGK

SEQ ID NO: 48 - protein, 697 aa, synthetic construct
  REGION 1..697: note = derived and/or modified protein sequence (wt) from YFV 17D__NC_002031.1__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 49 - protein, 527 aa, synthetic construct
  REGION 1..527: note = derived and/or modified protein sequence (wt) from YFV 17D__NC_002031.1__X-SS-E
MRGLSSRKRRSHDVLTVQFLILGMLLMTGGVTLVAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 50 - protein, 537 aa, synthetic construct
  REGION 1..537: note = derived and/or modified protein sequence (wt) from YFV 17D__NC_002031.1__X-SS-E-XX
MRGLSSRKRRSHDVLTVQFLILGMLLMTGGVTLVAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 51 - protein, 675 aa, synthetic construct
  REGION 1..675: note = derived and/or modified protein sequence (wt) from YFV 17D__NC_002031.1__SS-prME
DVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 52 - protein, 676 aa, synthetic construct
  REGION 1..676: note = derived and/or modified protein sequence (wt) from YFV 17D__NC_002031.1__SS-prME
MDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 53 - protein, 1027 aa, synthetic construct
  REGION 1..1027: note = derived and/or modified protein sequence (wt) from YFV 17D__NC_002031.1__SS-prME-NS1
DVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTA

SEQ ID NO: 54 - protein, 1028 aa, synthetic construct
  REGION 1..1028: note = derived and/or modified protein sequence (wt) from YFV 17D__NC_002031.1__SS-prME-NS1
MDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGKRELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTA

SEQ ID NO: 55 - protein, 91 aa, synthetic construct
  REGION 1..91: note = derived and/or modified protein sequence (wt) from YFV 17D__NC_002031.1__C (without X-SS)
MSGRKAQGKTLGVNMVRRGVRSLSNKIKQKTKQIGNRPGPSRGVQGFIFFFLFNILTGKKITAHLKRLWKMLDPRQGLAVLRKVKRVVASL

SEQ ID NO: 56 - protein, 342 aa, synthetic construct
  REGION 1..342: note = derived and/or modified protein sequence (wt) from YFV 17D__NC_002031.1__NS1 (without XX)
RELKCGDGIFIFRDSDDWLNKYSYYPEDPVKLASIVKASFEEGKCGLNSVDSLEHEMWRSRADEINAIFEENEVDISVVVQDPKNVYQRGTHPFSRIRDGLQYGWKTWGKNLVFSPGRKNGSFIIDGKSRKECPFSNRVWNSFQIEEFGTGVFTTRVYMDAVFEYTIDCDGSILGAAVNGKKSAHGSPTFWMGSHEVNGTWMIHTLEALDYKECEWPLTHTIGTSVEESEMFMPRSIGGPVSSHNHIPGYKVQTNGPWMQVPLEVKREACPGTSVIIDGNCDGRGKSTRSTTDSGKVIPEWCCRSCTMPPVSFHGSDGCWYPMEIRPRKTHESHLVRSWVTA

SEQ ID NO: 57 - RNA, 10233 nt, synthetic construct
  misc_feature 1..10233: note = derived and/or modified CDS sequence (wt) from YFV 17D__NC_002031.1__polyprotein
  source 1..10233: mol_type = other RNA
atgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagcttgcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccagaattcgggatggtctgcagtatggttggaagacttggggtaagaaccttgtgttctccccagggaggaagaatggaagcttcatcatagatggaaagtccaggaaagaatgcccgttttcaaaccgggtctggaattctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcttgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagctggagaaatacatgctgtcccttttggtttggtgagcatgatgatagcaatggaagtggtcctaaggaaaagacagggaccaaagcaaatgttggttggaggagtagtgctcttgggagcaatgctggtcgggcaagtaactctccttgatttgctgaaactcacagtggctgtgggattgcatttccatgagatgaacaatggaggagacgccatgtatatggcgttgattgctgccttttcaatcagaccagggctgctcatcggctttgggctcaggaccctatggagccctcgggaacgccttgtgctgaccctaggagcagccatggtggagattgccttgggtggcgtgatgggcggcctgtggaagtatctaaatgcagtttctctctgcatcctgacaataaatgctgttgcttctaggaaagcatcaaataccatcttgcccctcatggctctgttgacacctgtcactatggctgaggtgagacttgccgcaatgttcttttgtgccgtggttatcataggggtccttcaccagaatttcaaggacacctccatgcagaagactatacctctggtggccctcacactcacatcttacctgggcttgacacaaccttttttgggcctgtgtgcatttctggcaacccgcatatttgggcgaaggagtatcccagtgaatgaggcactcgcagcagctggtctagtgggagtgctggcaggactggcttttcaggagatggagaacttccttggtccgattgcagttggaggactcctgatgatgctggttagcgtggctgggagggtggatgggctagagctcaagaagcttggtgaagtttcatgggaagaggaggcggagatcagcgggagttccgcccgctatgatgtggcactcagtgaacaaggggagttcaagctgctttctgaagagaaagtgccatgggaccaggttgtgatgacctcgctggccttggttggggctgccctccatccatttgctcttctgctggtccttgctgggtggctgtttcatgtcaggggagctaggagaagtggggatgtcttgtgggatattcccactcctaagatcatcgaggaatgtgaacatctggaggatgggatttatggcatattccagtcaaccttcttgggggcctcccagcgaggagtgggagtggcacagggaggggtgttccacacaatgtggcatgtcacaagaggagctttccttgtcaggaatggcaagaagttgattccatcttgggcttcagtaaaggaagaccttgtcgcctatggtggctcatggaagttggaaggcagatgggatggagaggaagaggtccagttgatcgcggctgttccaggaaagaacgtggtcaacgtccagacaaaaccgagcttgttcaaagtgaggaatgggggagaaatcggggctgtcgctcttgactatccgagtggcacttcaggatctcctattgttaacaggaacggagaggtgattgggctgtacggcaatggcatccttgtcggtgacaactccttcgtgtccgccatatcccagactgaggtgaaggaagaaggaaaggaggagctccaagagatcccgacaatgctaaagaaaggaatgacaactgtccttgattttcatcctggagctgggaagacaagacgtttcctcccacagatcttggccgagtgcgcacggagacgcttgcgcactcttgtgttggcccccaccagggttgttctttctgaaatgaaggaggcttttcacggcctggacgtgaaattccacacacaggctttttccgctcacggcagcgggagagaagtcattgatgccatgtgccatgccaccctaacttacaggatgttggaaccaactagggttgttaactgggaagtgatcattatggatgaagcccattttttggatccagctagcatagccgctagaggttgggcagcgcacagagctagggcaaatgaaagtgcaacaatcttgatgacagccacaccgcctgggactagtgatgaatttccacattcaaatggtgaaatagaagatgttcaaacggacatacccagtgagccctggaacacagggcatgactggatcctagctgacaaaaggcccacggcatggttccttccatccatcagagctgcaaatgtcatggctgcctctttgcgtaaggctggaaagagtgtggtggtcctgaacaggaaaacctttgagagagaataccccacgataaagcagaagaaacctgactttatattggccactgacatagctgaaatgggagccaacctttgcgtggagcgagtgctggattgcaggacggcttttaagcctgtgcttgtggatgaagggaggaaggtggcaataaaagggccacttcgtatctccgcatcctctgctgctcaaaggagggggcgcattgggagaaatcccaacagagatggagactcatactactattctgagcctacaagtgaaaataatgcccaccacgtctgctggttggaggcctcaatgctcttggacaacatggaggtgaggggtggaatggtcgccccactctatggcgttgaaggaactaaaacaccagtttcccctggtgaaatgagactgagggatgaccagaggaaagtcttcagagaactagtgaggaattgtgacctgcccgtttggctttcgtggcaagtggccaaggctggtttgaagacgaatgatcgtaagtggtgttttgaaggccctgaggaacatgagatcttgaatgacagcggtgaaacagtgaagtgcagggctcctggaggagcaaagaagcctctgcgcccaaggtggtgtgatgaaagggtgtcatctgaccagagtgcgctgtctgaatttattaagtttgctgaaggtaggaggggagctgctgaagtgctagttgtgctgagtgaactccctgatttcctggctaaaaaaggtggagaggcaatggataccatcagtgtgttcctccactctgaggaaggctctagggcttaccgcaatgcactatcaatgatgcctgaggcaatgacaatagtcatgctgtttatactggctggactactgacatcgggaatggtcatctttttcatgtctcccaaaggcatcagtagaatgtctatggcgatgggcacaatggccggctgtggatatctcatgttccttggaggcgtcaaacccactcacatctcctatgtcatgctcatattctttgtcctgatggtggttgtgatccccgagccagggcaacaaaggtccatccaagacaaccaagtggcatacctcattattggcatcctgacgctggtttcagcggtggcagccaacgagctaggcatgctggagaaaaccaaagaggacctctttgggaagaagaacttaattccatctagtgcttcaccctggagttggccggatcttgacctgaagccaggagctgcctggacagtgtacgttggcattgttacaatgctctctccaatgttgcaccactggatcaaagtcgaatatggcaacctgtctctgtctggaatagcccagtcagcctcagtcctttctttcatggacaaggggataccattcatgaagatgaatatctcggtcataatgctgctggtcagtggctggaattcaataacagtgatgcctctgctctgtggcatagggtgcgccatgctccactggtctctcattttacctggaatcaaagcgcagcagtcaaagcttgcacagagaagggtgttccatggcgttgccgagaaccctgtggttgatgggaatccaacagttgacattgaggaagctcctgaaatgcctgccctttatgagaagaaactggctctatatctccttcttgctctcagcctagcttctgttgccatgtgcagaacgcccttttcattggctgaaggcattgtcctagcatcagctgccttagggccgctcatagagggaaacaccagccttctttggaatggacccatggctgtctccatgacaggagtcatgagggggaatcactatgcttttgtgggagtcatgtacaatctatggaagatgaaaactggacgccgggggagcgcgaatggaaaaactttgggtgaagtctggaagagggaactgaatctgttggacaagcgacagtttgagttgtataaaaggaccgacattgtggaggtggatcgtgatacggcacgcaggcatttggccgaagggaaggtggacaccggggtggcggtctccagggggaccgcaaagttaaggtggttccatgagcgtggctatgtcaagctggaaggtagggtgattgacctggggtgtggccgcggaggctggtgttactacgctgctgcgcaaaaggaagtgagtggggtcaaaggatttactcttggaagagacggccatgagaaacccatgaatgtgcaaagtctgggatggaacatcatcaccttcaaggacaaaactgatatccaccgcctagaaccagtgaaatgtgacacccttttgtgtgacattggagagtcatcatcgtcatcggtcacagagggggaaaggaccgtgagagttcttgatactgtagaaaaatggctggcttgtggggttgacaacttctgtgtgaaggtgttagctccatacatgccagatgttctcgagaaactggaattgctccaaaggaggtttggcggaacagtgatcaggaaccctctctccaggaattccactcatgaaatgtactacgtgtctggagcccgcagcaatgtcacatttactgtgaaccaaacatcccgcctcctgatgaggagaatgaggcgtccaactggaaaagtgaccctggaggctgacgtcatcctcccaattgggacacgcagtgttgagacagacaagggacccctggacaaagaggccatagaagaaagggttgagaggataaaatctgagtacatgacctcttggttttatgacaatgacaacccctacaggacctggcactactgtggctcctatgtcacaaaaacctcaggaagtgcggcgagcatggtaaatggtgttattaaaattctgacatatccatgggacaggatagaggaggtcacaagaatggcaatgactgacacaaccccttttggacagcaaagagtgtttaaagaaaaagttgacaccagagcaaaggatccaccagcgggaactaggaagatcatgaaagttgtcaacaggtggctgttccgccacctggccagagaaaagaaccccagactgtgcacaaaggaagaatttattgcaaaagtccgaagtcatgcagccattggagcttacctggaagaacaagaacagtggaagactgccaatgaggctgtccaagacccaaagttctgggaactggtggatgaagaaaggaagctgcaccaacaaggcaggtgtcggacttgtgtgtacaacatgatggggaaaagagagaagaagctgtcagagtttgggaaagcaaagggaagccgtgccatatggtatatgtggctgggagcgcggtatcttgagtttgaggccctgggattcctgaatgaggaccattgggcttccagggaaaactcaggaggaggagtggaaggcattggcttacaatacctaggatatgtgatcagagacctggctgcaatggatggtggtggattctacgcggatgacaccgctggatgggacacgcgcatcacagaggcagaccttgatgatgaacaggagatcttgaactacatgagcccacatcacaaaaaactggcacaagcagtgatggaaatgacatacaagaacaaagtggtgaaagtgttgagaccagccccaggagggaaagcctacatggatgtcataagtcgacgagaccagagaggatccgggcaggtagtgacttatgctctgaacaccatcaccaacttgaaagtccaattgatcagaatggcagaagcagagatggtgatacatcaccaacatgttcaagattgtgatgaatcagttctgaccaggctggaggcatggctcactgagcacggatgtgacagactgaagaggatggcggtgagtggagacgactgtgtggtccggcccatcgatgacaggttcggcctggccctgtcccatctcaacgccatgtccaaggttagaaaggacatatctgaatggcagccatcaaaagggtggaatgattgggagaatgtgcccttctgttcccaccacttccatgaactacagctgaaggatggcaggaggattgtggtgccttgccgagaacaggacgagctcattgggagaggaagggtgtctccaggaaacggctggatgatcaaggaaacagcttgcctcagcaaagcctatgccaacatgtggtcactgatgtattttcacaaaagggacatgaggctactgtcattggctgtttcctcagctgttcccacctcatgggttccacaaggacgcacaacatggtcgattcatgggaaaggggagtggatgaccacggaagacatgcttgaggtgtggaacagagtatggataaccaacaacccacacatgcaggacaagacaatggtgaaaaaatggagagatgtcccttatctaaccaagagacaagacaagctgtgcggatcactgattggaatgaccaatagggccacctgggcctcccacatccatttagtcatccatcgtatccgaacgctgattggacaggagaaatacactgactacctaacagtcatggacaggtattctgtggatgctgacctgcaactgggtgagcttatc

SEQ ID NO: 58 - RNA, 303 nt, synthetic construct
  misc_feature 1..303: note = derived and/or modified CDS sequence (wt) from YFV 17D__NC_002031.1__C
  source 1..303: mol_type = other RNA
atgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgt

SEQ ID NO: 59 - RNA, 363 nt, synthetic construct
  misc_feature 1..363: note = derived and/or modified CDS sequence (wt) from YFV 17D__NC_002031.1__C-ER anchor
  source 1..363: mol_type = other RNA
atgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtgga

SEQ ID NO: 60 - RNA, 267 nt, synthetic construct
  misc_feature 1..267: note = derived and/or modified CDS sequence (wt) from YFV 17D__NC_002031.1__pr
  source 1..267: mol_type = other RNA
gtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagg

SEQ ID NO: 61 - RNA, 225 nt, synthetic construct
  misc_feature 1..225: note = derived and/or modified CDS sequence (wt) from YFV 17D__NC_002031.1__M
  source 1..225: mol_type = other RNA
gccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactca

SEQ ID NO: 62 - RNA, 492 nt, synthetic construct
  misc_feature 1..492: note = derived and/or modified CDS sequence (wt) from YFV 17D__NC_002031.1__prM
  source 1..492: mol_type = other RNA
gtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactca

SEQ ID NO: 63 - RNA, 1479 nt, synthetic construct
  misc_feature 1..1479: note = derived and/or modified CDS sequence (wt) from YFV 17D__NC_002031.1__E
  source 1..1479: mol_type = other RNA
gctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 64 - RNA, 1971 nt, synthetic construct
  misc_feature 1..1971: note = derived and/or modified CDS sequence (wt) from YFV 17D__NC_002031.1__prME
  source 1..1971: mol_type = other RNA
gtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 65 - RNA, 2031 nt, synthetic construct
  misc_feature 1..2031: note = derived and/or modified CDS sequence (wt) from YFV 17D__NC_002031.1__ER anchor-prME
  source 1..2031: mol_type = other RNA
tcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 66 - RNA, 1056 nt, synthetic construct
  misc_feature 1..1056: note = derived and/or modified CDS sequence (wt) from YFV 17D__NC_002031.1__NS1
  source 1..1056: mol_type = other RNA
gatcaaggatgcgccatcaactttggcaagagagagctcaagtgcggagatggtatcttcatatttagagactctgatgactggctgaacaagtactcatactatccagaagatcctgtgaagcttgcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccagaattcgggatggtctgcagtatggttggaagacttggggtaagaaccttgtgttctccccagggaggaagaatggaagcttcatcatagatggaaagtccaggaaagaatgcccgttttcaaaccgggtctggaattctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcttgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagct

SEQ ID NO: 67 - RNA, 672 nt, synthetic construct
  misc_feature 1..672: note = derived and/or modified CDS sequence (wt) from YFV 17D__NC_002031.1__NS2A
  source 1..672: mol_type = other RNA
ggagaaatacatgctgtcccttttggtttggtgagcatgatgatagcaatggaagtggtcctaaggaaaagacagggaccaaagcaaatgttggttggaggagtagtgctcttgggagcaatgctggtcgggcaagtaactctccttgatttgctgaaactcacagtggctgtgggattgcatttccatgagatgaacaatggaggagacgccatgtatatggcgttgattgctgccttttcaatcagaccagggctgctcatcggctttgggctcaggaccctatggagccctcgggaacgccttgtgctgaccctaggagcagccatggtggagattgccttgggtggcgtgatgggcggcctgtggaagtatctaaatgcagtttctctctgcatcctgacaataaatgctgttgcttctaggaaagcatcaaataccatcttgcccctcatggctctgttgacacctgtcactatggctgaggtgagacttgccgcaatgttcttttgtgccgtggttatcataggggtccttcaccagaatttcaaggacacctccatgcagaagactatacctctggtggccctcacactcacatcttacctgggcttgacacaaccttttttgggcctgtgtgcatttctggcaacccgcatatttgggcgaagg

SEQ ID NO: 68 - RNA, 390 nt, synthetic construct
  misc_feature 1..390: note = derived and/or modified CDS sequence (wt) from YFV 17D__NC_002031.1__NS2B
  source 1..390: mol_type = other RNA
agtatcccagtgaatgaggcactcgcagcagctggtctagtgggagtgctggcaggactggcttttcaggagatggagaacttccttggtccgattgcagttggaggactcctgatgatgctggttagcgtggctgggagggtggatgggctagagctcaagaagcttggtgaagtttcatgggaagaggaggcggagatcagcgggagttccgcccgctatgatgtggcactcagtgaacaaggggagttcaagctgctttctgaagagaaagtgccatgggaccaggttgtgatgacctcgctggccttggttggggctgccctccatccatttgctcttctgctggtccttgctgggtggctgtttcatgtcaggggagctaggaga

SEQ ID NO: 69 - RNA, 1869 nt, synthetic construct
  misc_feature 1..1869: note = derived and/or modified CDS sequence (wt) from YFV 17D__NC_002031.1__NS3
  source 1..1869: mol_type = other RNA
agtggggatgtcttgtgggatattcccactcctaagatcatcgaggaatgtgaacatctggaggatgggatttatggcatattccagtcaaccttcttgggggcctcccagcgaggagtgggagtggcacagggaggggtgttccacacaatgtggcatgtcacaagaggagctttccttgtcaggaatggcaagaagttgattccatcttgggcttcagtaaaggaagaccttgtcgcctatggtggctcatggaagttggaaggcagatgggatggagaggaagaggtccagttgatcgcggctgttccaggaaagaacgtggtcaacgtccagacaaaaccgagcttgttcaaagtgaggaatgggggagaaatcggggctgtcgctcttgactatccgagtggcacttcaggatctcctattgttaacaggaacggagaggtgattgggctgtacggcaatggcatccttgtcggtgacaactccttcgtgtccgccatatcccagactgaggtgaaggaagaaggaaaggaggagctccaagagatcccgacaatgctaaagaaaggaatgacaactgtccttgattttcatcctggagctgggaagacaagacgtttcctcccacagatcttggccgagtgcgcacggagacgcttgcgcactcttgtgttggcccccaccagggttgttctttctgaaatgaaggaggcttttcacggcctggacgtgaaattccacacacaggctttttccgctcacggcagcgggagagaagtcattgatgccatgtgccatgccaccctaacttacaggatgttggaaccaactagggttgttaactgggaagtgatcattatggatgaagcccattttttggatccagctagcatagccgctagaggttgggcagcgcacagagctagggcaaatgaaagtgcaacaatcttgatgacagccacaccgcctgggactagtgatgaatttccacattcaaatggtgaaatagaagatgttcaaacggacatacccagtgagccctggaacacagggcatgactggatcctagctgacaaaaggcccacggcatggttccttccatccatcagagctgcaaatgtcatggctgcctctttgcgtaaggctggaaagagtgtggtggtcctgaacaggaaaacctttgagagagaataccccacgataaagcagaagaaacctgactttatattggccactgacatagctgaaatgggagccaacctttgcgtggagcgagtgctggattgcaggacggcttttaagcctgtgcttgtggatgaagggaggaaggtggcaataaaagggccacttcgtatctccgcatcctctgctgctcaaaggagggggcgcattgggagaaatcccaacagagatggagactcatactactattctgagcctacaagtgaaaataatgcccaccacgtctgctggttggaggcctcaatgctcttggacaacatggaggtgaggggtggaatggtcgccccactctatggcgttgaaggaactaaaacaccagtttcccctggtgaaatgagactgagggatgaccagaggaaagtcttcagagaactagtgaggaattgtgacctgcccgtttggctttcgtggcaagtggccaaggctggtttgaagacgaatgatcgtaagtggtgttttgaaggccctgaggaacatgagatcttgaatgacagcggtgaaacagtgaagtgcagggctcctggaggagcaaagaagcctctgcgcccaaggtggtgtgatgaaagggtgtcatctgaccagagtgcgctgtctgaatttattaagtttgctgaaggtaggagg

SEQ ID NO: 70 - RNA, 447 nt, synthetic construct
  misc_feature 1..447: note = derived and/or modified CDS sequence (wt) from YFV 17D__NC_002031.1__NS4A-P2K
  source 1..447: mol_type = other RNA
ggagctgctgaagtgctagttgtgctgagtgaactccctgatttcctggctaaaaaaggtggagaggcaatggataccatcagtgtgttcctccactctgaggaaggctctagggcttaccgcaatgcactatcaatgatgcctgaggcaatgacaatagtcatgctgtttatactggctggactactgacatcgggaatggtcatctttttcatgtctcccaaaggcatcagtagaatgtctatggcgatgggcacaatggccggctgtggatatctcatgttccttggaggcgtcaaacccactcacatctcctatgtcatgctcatattctttgtcctgatggtggttgtgatccccgagccagggcaacaaaggtccatccaagacaaccaagtggcatacctcattattggcatcctgacgctggtttcagcggtggcagcc

SEQ ID NO: 71 - RNA, 750 nt, synthetic construct
  misc_feature 1..750: note = derived and/or modified CDS sequence (wt) from YFV 17D__NC_002031.1__NS4B
  source 1..750: mol_type = other RNA
aacgagctaggcatgctggagaaaaccaaagaggacctctttgggaagaagaacttaattccatctagtgcttcaccctggagttggccggatcttgacctgaagccaggagctgcctggacagtgtacgttggcattgttacaatgctctctccaatgttgcaccactggatcaaagtcgaatatggcaacctgtctctgtctggaatagcccagtcagcctcagtcctttctttcatggacaaggggataccattcatgaagatgaatatctcggtcataatgctgctggtcagtggctggaattcaataacagtgatgcctctgctctgtggcatagggtgcgccatgctccactggtctctcattttacctggaatcaaagcgcagcagtcaaagcttgcacagagaagggtgttccatggcgttgccgagaaccctgtggttgatgggaatccaacagttgacattgaggaagctcctgaaatgcctgccctttatgagaagaaactggctctatatctccttcttgctctcagcctagcttctgttgccatgtgcagaacgcccttttcattggctgaaggcattgtcctagcatcagctgccttagggccgctcatagagggaaacaccagccttctttggaatggacccatggctgtctccatgacaggagtcatgagggggaatcactatgcttttgtgggagtcatgtacaatctatggaagatgaaaactggacgccgg

SEQ ID NO: 72 - RNA, 2715 nt, synthetic construct
  misc_feature 1..2715: note = derived and/or modified CDS sequence (wt) from YFV 17D__NC_002031.1__NS5
  source 1..2715: mol_type = other RNA
gggagcgcgaatggaaaaactttgggtgaagtctggaagagggaactgaatctgttggacaagcgacagtttgagttgtataaaaggaccgacattgtggaggtggatcgtgatacggcacgcaggcatttggccgaagggaaggtggacaccggggtggcggtctccagggggaccgcaaagttaaggtggttccatgagcgtggctatgtcaagctggaaggtagggtgattgacctggggtgtggccgcggaggctggtgttactacgctgctgcgcaaaaggaagtgagtggggtcaaaggatttactcttggaagagacggccatgagaaacccatgaatgtgcaaagtctgggatggaacatcatcaccttcaaggacaaaactgatatccaccgcctagaaccagtgaaatgtgacacccttttgtgtgacattggagagtcatcatcgtcatcggtcacagagggggaaaggaccgtgagagttcttgatactgtagaaaaatggctggcttgtggggttgacaacttctgtgtgaaggtgttagctccatacatgccagatgttctcgagaaactggaattgctccaaaggaggtttggcggaacagtgatcaggaaccctctctccaggaattccactcatgaaatgtactacgtgtctggagcccgcagcaatgtcacatttactgtgaaccaaacatcccgcctcctgatgaggagaatgaggcgtccaactggaaaagtgaccctggaggctgacgtcatcctcccaattgggacacgcagtgttgagacagacaagggacccctggacaaagaggccatagaagaaagggttgagaggataaaatctgagtacatgacctcttggttttatgacaatgacaacccctacaggacctggcactactgtggctcctatgtcacaaaaacctcaggaagtgcggcgagcatggtaaatggtgttattaaaattctgacatatccatgggacaggatagaggaggtcacaagaatggcaatgactgacacaaccccttttggacagcaaagagtgtttaaagaaaaagttgacaccagagcaaaggatccaccagcgggaactaggaagatcatgaaagttgtcaacaggtggctgttccgccacctggccagagaaaagaaccccagactgtgcacaaaggaagaatttattgcaaaagtccgaagtcatgcagccattggagcttacctggaagaacaagaacagtggaagactgccaatgaggctgtccaagacccaaagttctgggaactggtggatgaagaaaggaagctgcaccaacaaggcaggtgtcggacttgtgtgtacaacatgatggggaaaagagagaagaagctgtcagagtttgggaaagcaaagggaagccgtgccatatggtatatgtggctgggagcgcggtatcttgagtttgaggccctgggattcctgaatgaggaccattgggcttccagggaaaactcaggaggaggagtggaaggcattggcttacaatacctaggatatgtgatcagagacctggctgcaatggatggtggtggattctacgcggatgacaccgctggatgggacacgcgcatcacagaggcagaccttgatgatgaacaggagatcttgaactacatgagcccacatcacaaaaaactggcacaagcagtgatggaaatgacatacaagaacaaagtggtgaaagtgttgagaccagccccaggagggaaagcctacatggatgtcataagtcgacgagaccagagaggatccgggcaggtagtgacttatgctctgaacaccatcaccaacttgaaagtccaattgatcagaatggcagaagcagagatggtgatacatcaccaacatgttcaagattgtgatgaatcagttctgaccaggctggaggcatggctcactgagcacggatgtgacagactgaagaggatggcggtgagtggagacgactgtgtggtccggcccatcgatgacaggttcggcctggccctgtcccatctcaacgccatgtccaaggttagaaaggacatatctgaatggcagccatcaaaagggtggaatgattgggagaatgtgcccttctgttcccaccacttccatgaactacagctgaaggatggcaggaggattgtggtgccttgccgagaacaggacgagctcattgggagaggaagggtgtctccaggaaacggctggatgatcaaggaaacagcttgcctcagcaaagcctatgccaacatgtggtcactgatgtattttcacaaaagggacatgaggctactgtcattggctgtttcctcagctgttcccacctcatgggttccacaaggacgcacaacatggtcgattcatgggaaaggggagtggatgaccacggaagacatgcttgaggtgtggaacagagtatggataaccaacaacccacacatgcaggacaagacaatggtgaaaaaatggagagatgtcccttatctaaccaagagacaagacaagctgtgcggatcactgattggaatgaccaatagggccacctgggcctcccacatccatttagtcatccatcgtatccgaacgctgattggacaggagaaatacactgactacctaacagtcatggacaggtattctgtggatgctgacctgcaactgggtgagcttatc

SEQ ID NO: 73 - RNA, 2334 nt, synthetic construct
  misc_feature 1..2334: note = derived and/or modified CDS sequence (wt) from YFV 17D__NC_002031.1__C-prME
  source 1..2334: mol_type = other RNA
atgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 74 - RNA, 3390 nt, synthetic construct
  misc_feature 1..3390: note = derived and/or modified CDS sequence (wt) from YFV 17D__NC_002031.1__C-prME-NS1
  source 1..3390: mol_type = other RNA
atgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagttggcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccaggattcgggatggtctgcagtatggttggaagacttggggtaagaaccttgtgttctccccagggaggaagaatgggagcttcatcatagatggaaagtccaggaaagaatgcccgttttcaaaccgggtctggaactctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcatgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagct

SEQ ID NO: 75 - RNA, 30 nt, synthetic construct
  misc_feature 1..30: note = derived and/or modified CDS sequence (wt) from YFV 17D__NC_002031.1__X or 10aa (5'-terminus)
  source 1..30: mol_type = other RNA
atgagaggattgtcctcaaggaaacgccgt

SEQ ID NO: 76 - RNA, 60 nt, synthetic construct
  misc_feature 1..60: note = derived and/or modified CDS sequence (wt) from YFV 17D__NC_002031.1__SS or ER anchor (v1)
  source 1..60: mol_type = other RNA
tcccatgatgttctgactgtgcaattcctaattttgggaatgctgttgatgacgggtgga

SEQ ID NO: 77 - RNA, 54 nt, synthetic construct
  misc_feature 1..54: note = derived and/or modified CDS sequence (wt) from YFV 17D__NC_002031.1__SS or ER anchor (v2)
  source 1..54: mol_type = other RNA
gatgttctgactgtgcaattcctaattttgggaatgctgttgatgacgggtgga

SEQ ID NO: 78 - RNA, 72 nt, synthetic construct
  misc_feature 1..72: note = derived and/or modified CDS sequence (wt) from YFV 17D__NC_002031.1__SS or ER anchor (v4)
  source 1..72: mol_type = other RNA
tcccatgatgttctgactgtgcaattcctaattttgggaatgctgttgatgacgggtggagtgaccttggtg

SEQ ID NO: 79 - RNA, 90 nt, synthetic construct
  misc_feature 1..90: note = derived and/or modified CDS sequence (wt) from YFV 17D__NC_002031.1__X-SS or 10aa (5'-terminus)-SS (v1)
  source 1..90: mol_type = other RNA
atgagaggattgtcctcaaggaaacgccgttcccatgatgttctgactgtgcaattcctaattttgggaatgctgttgatgacgggtgga

SEQ ID NO: 80 - RNA, 102 nt, synthetic construct
  misc_feature 1..102: note = derived and/or modified CDS sequence (wt) from YFV 17D__NC_002031.1__X-SS or 10aa (5'-terminus)-SS (v2)
  source 1..102: mol_type = other RNA
atgagaggattgtcctcaaggaaacgccgttcccatgatgttctgactgtgcaattcctaattttgggaatgctgttgatgacgggtggagtgaccttggtg

SEQ ID NO: 81 - RNA, 30 nt, synthetic construct
  misc_feature 1..30: note = derived and/or modified CDS sequence (wt) from YFV 17D__NC_002031.1__XX or 10aa (3'-terminus)
  source 1..30: mol_type = other RNA
gatcaaggatgcgccatcaactttggcaag

SEQ ID NO: 82 - RNA, 2091 nt, synthetic construct
  misc_feature 1..2091: note = derived and/or modified CDS sequence (wt) from YFV 17D__NC_002031.1__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaatccatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 83 - RNA, 1581 nt, synthetic construct
  misc_feature 1..1581: note = derived and/or modified CDS sequence (wt) from YFV 17D__NC_002031.1__X-SS-E
  source 1..1581: mol_type = other RNA
atgagaggattgtcctcaaggaaacgccgttcccatgatgttctgactgtgcaattcctaattttgggaatgctgttgatgacgggtggagtgaccttggtggctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 84 - RNA, 1611 nt, synthetic construct
  misc_feature 1..1611: note = derived and/or modified CDS sequence (wt) from YFV 17D__NC_002031.1__X-SS-E-XX
  source 1..1611: mol_type = other RNA
atgagaggattgtcctcaaggaaacgccgttcccatgatgttctgactgtgcaattcctaattttgggaatgctgttgatgacgggtggagtgaccttggtggctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 85 - RNA, 2025 nt, synthetic construct
  misc_feature 1..2025: note = derived and/or modified CDS sequence (wt) from YFV 17D__NC_002031.1__SS-prME
  source 1..2025: mol_type = other RNA
gatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 86 - RNA, 3081 nt, synthetic construct
  misc_feature 1..3081: note = derived and/or modified CDS sequence (wt) from YFV 17D__NC_002031.1__SS-prME-NS1
  source 1..3081: mol_type = other RNA
gatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagttggcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccaggattcgggatggtctgcagtatggttggaagacttggggtaagaaccttgtgttctccccagggaggaagaatgggagcttcatcatagatggaaagtccaggaaagaatgcccgttttcaaaccgggtctggaactctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcatgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagct

SEQ ID NO: 87 - RNA, 273 nt, synthetic construct
  misc_feature 1..273: note = derived and/or modified CDS sequence (wt) from YFV 17D__NC_002031.1__C (without X-SS)
  source 1..273: mol_type = other RNA
atgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttg

SEQ ID NO: 88 - RNA, 1026 nt, synthetic construct
  misc_feature 1..1026: note = derived and/or modified CDS sequence (wt) from YFV 17D__NC_002031.1__NS1 (without XX)
  source 1..1026: mol_type = other RNA
agagagctcaagtgcggagatggtatcttcatatttagagactctgatgactggctgaacaagtactcatactatccagaagatcctgtgaagcttgcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccagaattcgggatggtctgcagtatggttggaagacttggggtaagaaccttgtgttctccccagggaggaagaatggaagcttcatcatagatggaaagtccaggaaagaatgcccgttttcaaaccgggtctggaattctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcttgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagct

SEQ ID NO: 89 - RNA, 10233 nt, synthetic construct
  misc_feature 1..10233: note = derived and/or modified CDS sequence (opt1) from YFV 17D__NC_002031.1__polyprotein
  source 1..10233: mol_type = other RNA
atgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctgtacaagctccacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtgaaggtcagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagagcgcccacgggtccccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtgcccctcgaggtgaagcgggaggcctgcccgggcaccagcgtcatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtaccccatggagatccggccccgcaagacgcacgagtcccacctggtccggagctgggtgaccgccggcgagatccacgccgtgcccttcgggctggtctccatgatgatcgccatggaggtggtgctccgcaagcggcagggccccaagcagatgctggtcggcggggtggtgctgctcggcgcgatgctggtcgggcaggtgaccctgctcgacctgctgaagctcaccgtggccgtcggcctgcacttccacgagatgaacaacgggggcgacgccatgtacatggccctgatcgccgcgttcagcatccgcccgggcctcctgatcgggttcggcctgcgcacgctctggagcccccgggagcgcctggtgctgaccctcggggccgccatggtggagatcgccctgggcggggtcatgggcggcctgtggaagtacctcaacgcggtgtccctgtgcatcctgaccatcaacgccgtggccagccggaaggcctccaacaccatcctccccctgatggccctgctcacccccgtcacgatggcggaggtgcgcctggccgccatgttcttctgcgccgtggtcatcatcggggtgctgcaccagaacttcaaggacaccagcatgcagaagaccatcccgctcgtggccctgaccctgacgtcctacctcggcctgacccagcccttcctggggctctgcgcgttcctggccacccggatcttcggccgccggagcatccccgtcaacgaggccctggccgccgcggggctcgtgggcgtgctggccggcctggccttccaggagatggagaacttcctcgggcccatcgccgtcggcgggctgctgatgatgctcgtgtccgtggccggccgcgtcgacggcctggagctgaagaagctcggggaggtgagctgggaggaggaggcggagatctccggcagctccgcccggtacgacgtggccctgagcgagcagggggagttcaagctgctctccgaggagaaggtcccgtgggaccaggtggtgatgaccagcctggccctggtcggcgcggccctccaccccttcgccctgctgctcgtgctggccgggtggctgttccacgtgcgcggcgcccggcgctccggcgacgtcctctgggacatccccacgcccaagatcatcgaggagtgcgagcacctggaggacgggatctacggcatcttccagagcaccttcctgggggcgtcccagcggggcgtgggggtcgcccagggcggcgtgttccacaccatgtggcacgtgacccgcggggccttcctcgtccggaacggcaagaagctgatcccgagctgggcctccgtgaaggaggacctggtggcctacgggggcagctggaagctcgaggggcgctgggacggcgaggaggaggtccagctgatcgcggccgtgcccggcaagaacgtggtcaacgtgcagacgaagcccagcctgttcaaggtgcggaacgggggcgagatcggggccgtcgccctggactacccgtccggcaccagcgggtcccccatcgtgaaccgcaacggcgaggtgatcggcctctacgggaacggcatcctggtcggggacaacagcttcgtgtccgccatcagccagaccgaggtgaaggaggagggcaaggaggagctgcaggagatccccaccatgctcaagaagggcatgacgaccgtcctggacttccaccccggggcgggcaagacccggcgcttcctgccgcagatcctcgccgagtgcgcccgccggcgcctgcggaccctggtgctcgcccccacgcgcgtggtcctgtccgagatgaaggaggcgttccacgggctggacgtgaagttccacacccaggccttcagcgcccacggctccgggcgggaggtgatcgacgccatgtgccacgccaccctcacctaccgcatgctggagcccacgcgggtcgtgaactgggaggtgatcatcatggacgaggcgcacttcctggaccccgccagcatcgccgcccgcggctgggccgcgcaccgggcccgcgccaacgagtccgccaccatcctcatgaccgccaccccgcccggcacgagcgacgagttcccccactccaacggggagatcgaggacgtccagaccgacatccccagcgagccgtggaacaccggccacgactggatcctggcggacaagcggcccaccgcctggttcctgccctccatccgcgccgccaacgtgatggcggccagcctccggaaggccgggaagtccgtggtcgtgctgaaccgcaagacgttcgagcgggagtaccccaccatcaagcagaagaagccggacttcatcctggccaccgacatcgccgagatgggcgcgaacctctgcgtggagcgcgtcctggactgccggaccgccttcaagcccgtgctggtggacgaggggcgcaaggtcgccatcaagggccccctccggatcagcgcctccagcgccgcgcagcgccggggccgcatcgggcgcaaccccaaccgggacggcgacagctactactactccgagccgacgagcgagaacaacgcccaccacgtgtgctggctggaggcctccatgctgctcgacaacatggaggtgcgcgggggcatggtcgccccgctgtacggggtggagggcaccaagacccccgtgagccccggcgagatgcggctgcgcgacgaccagcggaaggtcttccgcgagctcgtgcggaactgcgacctgccggtgtggctgtcctggcaggtcgccaaggcggggctcaagaccaacgaccgcaagtggtgcttcgagggccccgaggagcacgagatcctgaacgacagcggggagaccgtgaagtgccgggcccccggcggcgccaagaagcccctgcgcccgcggtggtgcgacgagcgcgtgtccagcgaccagtccgccctcagcgagttcatcaagttcgccgaggggcggcgcggcgcggccgaggtcctggtggtgctgtccgagctccccgacttcctggccaagaagggcggcgaggccatggacacgatcagcgtcttcctgcactccgaggaggggagccgggcgtaccgcaacgccctctccatgatgcccgaggccatgaccatcgtgatgctgttcatcctggccgggctcctgaccagcggcatggtcatcttcttcatgtccccgaaggggatcagccggatgtccatggccatgggcaccatggcggggtgcggctacctgatgttcctcgggggcgtgaagcccacgcacatcagctacgtgatgctgatcttcttcgtcctgatggtggtggtcatccccgagcccggccagcagcgcagcatccaggacaaccaggtggcctacctcatcatcgggatcctgaccctggtgtccgccgtcgccgccaacgagctcggcatgctggagaagaccaaggaggacctgttcgggaagaagaacctcatcccgagctccgcgagcccctggtcctggcccgacctggacctgaagcccggcgccgcctggaccgtgtacgtggggatcgtcacgatgctcagcccgatgctgcaccactggatcaaggtggagtacggcaacctgtccctcagcggcatcgcccagtccgccagcgtgctgtccttcatggacaaggggatccccttcatgaagatgaacatcagcgtcatcatgctgctcgtgtccggctggaacagcatcaccgtgatgcccctgctgtgcgggatcggctgcgcgatgctccactggtccctgatcctgcccgggatcaaggcccagcagagcaagctcgcccagcggcgcgtcttccacggcgtggccgagaacccggtggtcgacggcaaccccaccgtggacatcgaggaggcgcccgagatgcccgccctgtacgagaagaagctggccctctacctgctgctcgccctgtccctggccagcgtggcgatgtgccgcaccccgttctccctcgccgaggggatcgtcctggccagcgccgccctgggccccctcatcgaggggaacacgagcctgctgtggaacggccccatggcggtgtccatgaccggcgtgatgcgggggaaccactacgccttcgtcggcgtgatgtacaacctctggaagatgaagaccgggcgccggggcagcgccaacgggaagaccctgggcgaggtgtggaagcgcgagctgaacctcctggacaagcggcagttcgagctgtacaagcgcacggacatcgtcgaggtggaccgggacaccgcccgccggcacctcgccgagggcaaggtggacaccggggtcgcggtgtcccgcggcaccgccaagctgcggtggttccacgagcgcgggtacgtgaagctggagggccgggtcatcgacctcgggtgcggccgcggcgggtggtgctactacgccgccgcgcagaaggaggtgagcggcgtgaaggggttcacgctgggccgggacgggcacgagaagcccatgaacgtccagtccctgggctggaacatcatcaccttcaaggacaagaccgacatccaccgcctggagccggtgaagtgcgacaccctcctgtgcgacatcggcgagagctccagctccagcgtgacggagggggagcggaccgtccgcgtgctggacaccgtggagaagtggctcgcctgcggcgtcgacaacttctgcgtgaaggtgctggccccctacatgcccgacgtcctggagaagctcgagctgctgcagcggcgcttcgggggcaccgtgatccggaaccccctctcccgcaacagcacgcacgagatgtactacgtgtccggcgcccgcagcaacgtcaccttcaccgtgaaccagacctcccggctgctgatgcgccggatgcgccggccgacggggaaggtcaccctcgaggccgacgtgatcctgcccatcggcacccgcagcgtggagaccgacaaggggcccctggacaaggaggcgatcgaggagcgggtcgagcgcatcaagtccgagtacatgacgagctggttctacgacaacgacaacccctaccggacctggcactactgcggcagctacgtgaccaagacctccgggagcgccgcctccatggtgaacggcgtcatcaagatcctcacgtacccgtgggaccgcatcgaggaggtgacccggatggccatgaccgacaccacccccttcggccagcagcgcgtgttcaaggagaaggtcgacacgcgggccaaggacccgccggcggggacccgcaagatcatgaaggtggtgaaccggtggctgttccgccacctggcccgggagaagaacccccgcctctgcaccaaggaggagttcatcgccaaggtccggagccacgccgccatcggcgcgtacctggaggagcaggagcagtggaagaccgccaacgaggccgtgcaggaccccaagttctgggagctggtggacgaggagcgcaagctccaccagcaggggcgctgccggacgtgcgtctacaacatgatgggcaagcgcgagaagaagctgtccgagttcgggaaggccaagggcagccgggccatctggtacatgtggctgggcgcgcgctacctcgagttcgaggccctggggttcctgaacgaggaccactgggcctcccgggagaacagcggcgggggcgtggaggggatcggcctccagtacctgggctacgtgatccgcgacctggccgcgatggacgggggcgggttctacgccgacgacaccgccggctgggacacccggatcaccgaggccgacctcgacgacgagcaggagatcctgaactacatgtccccgcaccacaagaagctggcccaggcggtcatggagatgacgtacaagaacaaggtggtgaaggtcctccgcccggcccccgggggcaaggcctacatggacgtgatcagccggcgcgaccagcggggctccgggcaggtggtcacctacgccctgaacaccatcaccaacctgaaggtgcagctcatccgcatggccgaggcggagatggtgatccaccaccagcacgtccaggactgcgacgagagcgtgctgacgcggctggaggcctggctcaccgagcacggctgcgaccgcctgaagcggatggccgtgtccggggacgactgcgtcgtgcgccccatcgacgaccggttcggcctggccctcagccacctgaacgccatgtccaaggtgcgcaaggacatcagcgagtggcagccctccaagggctggaacgactgggagaacgtccccttctgcagccaccacttccacgagctgcagctcaaggacgggcggcgcatcgtggtgccctgccgggagcaggacgagctgatcggccgcgggcgcgtctcccccggcaacgggtggatgatcaaggagaccgcgtgcctgagcaaggcctacgccaacatgtggagcctcatgtacttccacaagcgggacatgcgcctgctgtccctcgccgtgagctccgcggtgcccaccagctgggtcccgcagggccggacgacctggtccatccacggcaagggggagtggatgaccaccgaggacatgctggaggtgtggaaccgcgtgtggatcacgaacaacccccacatgcaggacaagaccatggtcaagaagtggcgggacgtgccctacctgaccaagcgccaggacaagctctgcggcagcctgatcgggatgaccaaccgggccacgtgggcctcccacatccacctggtgatccaccgcatccggaccctcatcggccaggagaagtacaccgactacctgaccgtcatggaccgctacagcgtggacgccgacctgcagctcggggagctgatc

SEQ ID NO: 90 - RNA, 303 nt, synthetic construct
  misc_feature 1..303: note = derived and/or modified CDS sequence (opt1) from YFV 17D__NC_002031.1__C
  source 1..303: mol_type = other RNA
atgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccgg

SEQ ID NO: 91 - RNA, 363 nt, synthetic construct
  misc_feature 1..363: note = derived and/or modified CDS sequence (opt1) from YFV 17D__NC_002031.1__C-ER anchor
  source 1..363: mol_type = other RNA
atgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggc

SEQ ID NO: 92 - RNA, 267 nt, synthetic construct
  misc_feature 1..267: note = derived and/or modified CDS sequence (opt1) from YFV 17D__NC_002031.1__pr
  source 1..267: mol_type = other RNA
gtgaccctggtccgcaagaaccggtggctcctgctgaacgtgaccagcgaggacctcggcaagacgttctccgtggggaccggcaactgcaccaccaacatcctggaggccaagtactggtgccccgacagcatggagtacaactgcccgaacctgtccccgcgcgaggagcccgacgacatcgactgctggtgctacggggtcgagaacgtgcgggtggcctacggcaagtgcgacagcgcggggcgctcccggcgcagccggcgc

SEQ ID NO: 93 - RNA, 225 nt, synthetic construct
  misc_feature 1..225: note = derived and/or modified CDS sequence (opt1) from YFV 17D__NC_002031.1__M
  source 1..225: mol_type = other RNA
gccatcgacctgcccacccacgagaaccacggcctcaagacccgccaggagaagtggatgacggggcggatgggcgagcgccagctgcagaagatcgagcggtggttcgtgcgcaacccgttcttcgccgtcaccgcgctgaccatcgcctacctcgtggggagcaacatgacccagcgggtggtcatcgccctgctggtgctcgccgtgggccccgcctactcc

SEQ ID NO: 94 - RNA, 492 nt, synthetic construct
  misc_feature 1..492: note = derived and/or modified CDS sequence (opt1) from YFV 17D__NC_002031.1__prM
  source 1..492: mol_type = other RNA
gtgaccctggtccgcaagaaccggtggctcctgctgaacgtgaccagcgaggacctcggcaagacgttctccgtggggaccggcaactgcaccaccaacatcctggaggccaagtactggtgcccggacagcatggagtacaactgcccgaacctgtccccgcgcgaggagcccgacgacatcgactgctggtgctacggggtcgagaacgtgcgggtggcctacggcaagtgcgacagcgcggggcgctcccggcgcagccggcgcgccatcgacctccccacgcacgagaaccacggcctgaagacccggcaggagaagtggatgaccggccgcatgggggagcggcagctgcagaagatcgagcgctggttcgtccggaaccccttcttcgccgtgaccgccctcacgatcgcctacctggtgggctccaacatgacccagcgcgtcgtgatcgcgctgctcgtgctggccgtcgggcccgcctacagc

SEQ ID NO: 95 - RNA, 1479 nt, synthetic construct
  misc_feature 1..1479: note = derived and/or modified CDS sequence (opt1) from YFV 17D__NC_002031.1__E
  source 1..1479: mol_type = other RNA
gcccactgcatcggcatcaccgaccgcgacttcatcgagggggtgcacggcgggacctgggtcagcgccacgctggagcaggacaagtgcgtgaccgtgatggcgcccgacaagccctccctcgacatcagcctggagaccgtcgccatcgaccggcccgccgaggtgcgcaaggtgtgctacaacgccgtcctgacccacgtgaagatcaacgacaagtgcccctccacgggcgaggcccacctcgcggaggagaacgagggggacaacgcctgcaagcggacctacagcgaccgcggctggggcaacgggtgcggcctgttcgggaagggctccatcgtggcctgcgccaagttcacctgcgcgaagagcatgtccctgttcgaggtcgaccagaccaagatccagtacgtgatccgggcccagctccacgtgggggccaagcaggagaactggaacacggacatcaagaccctgaagttcgacgccctgagcggctcccaggaggtcgagttcatcggctacgggaaggccaccctcgagtgccaggtgcagaccgcggtggacttcggcaacagctacatcgccgagatggagacggagtcctggatcgtcgaccgccagtgggcccaggacctgaccctgccctggcagagcgggtccggcggcgtgtggcgggagatgcaccacctcgtggagttcgagccgccccacgccgccaccatccgcgtcctggcgctggggaaccaggagggcagcctcaagaccgccctgacgggggccatgcgggtgaccaaggacaccaacgacaacaacctgtacaagctccacggcgggcacgtgtcctgccgcgtcaagctgagcgccctgaccctcaagggcacgtcctacaagatctgcaccgacaagatgttcttcgtgaagaaccccaccgacaccggccacgggacggtggtcatgcaggtgaaggtcagcaagggcgccccctgccggatcccggtgatcgtggcggacgacctgaccgccgccatcaacaaggggatcctggtcaccgtgaacccgatcgcctccaccaacgacgacgaggtgctcatcgaggtcaacccgcccttcggcgacagctacatcatcgtggggcgcggcgacagccggctgacgtaccagtggcacaaggagggctccagcatcgggaagctgttcacccagaccatgaagggcgtggagcgcctcgccgtcatgggggacaccgcgtgggacttctccagcgccggcgggttcttcacgtccgtgggcaagggcatccacaccgtgttcgggagcgccttccagggcctgttcgggggcctgaactggatcaccaaggtcatcatgggcgccgtgctcatctgggtggggatcaacacccggaacatgacgatgtccatgagcatgatcctggtcggcgtgatcatgatgttcctgtccctcggggtgggcgcg

SEQ ID NO: 96 - RNA, 1971 nt, synthetic construct
  misc_feature 1..1971: note = derived and/or modified CDS sequence (opt1) from YFV 17D__NC_002031.1__prME
  source 1..1971: mol_type = other RNA
gtgaccctggtccgcaagaaccggtggctcctgctgaacgtgaccagcgaggacctcggcaagacgttctccgtggggaccggcaactgcaccaccaacatcctggaggccaagtactggtgccccgacagcatggagtacaactgcccgaacctgtccccgcgcgaggagcccgacgacatcgactgctggtgctacggggtcgagaacgtgcgggtggcctacggcaagtgcgacagcgcggggcgctcccggcgcagccggcgcgccatcgacctccccacgcacgagaaccacggcctgaagacccggcaggagaagtggatgaccggccgcatgggggagcggcagctgcagaagatcgagcgctggttcgtccggaaccccttcttcgccgtgaccgccctcacgatcgcctacctggtgggctccaacatgacccagcgcgtcgtgatcgcgctgctcgtgctggccgtcgggcccgcctacagcgcccactgcatcggcatcaccgaccgggacttcatcgagggggtgcacggcggcacctgggtgtccgcgacgctggagcaggacaagtgcgtcaccgtgatggcccccgacaagcccagcctcgacatctccctggagaccgtggccatcgaccgcccggccgaggtccggaaggtgtgctacaacgccgtgctgacccacgtcaagatcaacgacaagtgccccagcacgggggaggcgcacctcgccgaggagaacgagggcgacaacgcctgcaagcgcacctactccgaccgggggtggggcaacggctgcgggctgttcggcaaggggagcatcgtggcctgcgccaagttcacctgcgcgaagtccatgagcctgttcgaggtggaccagaccaagatccagtacgtcatccgcgcccagctccacgtgggcgccaagcaggagaactggaacacggacatcaagaccctgaagttcgacgccctgtccgggagccaggaggtcgagttcatcggctacggcaaggccaccctcgagtgccaggtgcagaccgcggtggacttcgggaactcctacatcgccgagatggagacggagagctggatcgtcgaccggcagtgggcccaggacctgaccctgccctggcagagcggctccgggggcgtgtggcgcgagatgcaccacctcgtggagttcgagcccccgcacgccgccaccatccgcgtcctggcgctggggaaccaggagggcagcctcaagaccgccctgacgggcgccatgcgggtgaccaaggacaccaacgacaacaacctgtacaagctccacgggggccacgtgtcctgccgcgtcaagctgagcgccctgaccctcaaggggacgtcctacaagatctgcaccgacaagatgttcttcgtgaagaaccccaccgacaccggccacgggacggtggtcatgcaggtgaaggtgagcaagggcgcgccctgccggatccccgtcatcgtggccgacgacctgaccgccgccatcaacaagggcatcctggtgaccgtcaacccgatcgcctccaccaacgacgacgaggtgctcatcgaggtgaacccgcccttcggggacagctacatcatcgtcggccgcggggactcccggctgacctaccagtggcacaaggagggcagctccatcggcaagctgttcacgcagaccatgaagggggtggagcgcctcgcggtgatgggcgacaccgcctgggacttcagctccgccgggggcttcttcaccagcgtcgggaagggcatccacacggtgttcggctccgccttccaggggctgttcggcgggctgaactggatcaccaaggtgatcatgggcgccgtcctcatctgggtggggatcaacacccggaacatgaccatgagcatgtccatgatcctggtgggcgtcatcatgatgttcctgagcctgggcgtgggggcg

SEQ ID NO: 97 - RNA, 2031 nt, synthetic construct
  misc_feature 1..2031: note = derived and/or modified CDS sequence (opt1) from YFV 17D__NC_002031.1__ER anchor-prME
  source 1..2031: mol_type = other RNA
agccacgacgtgctgaccgtccagttcctcatcctgggcatgctgctcatgaccgggggcgtgacgctggtgcgcaagaaccggtggctgctcctgaacgtcacctccgaggacctggggaagaccttcagcgtgggcaccgggaactgcacgaccaacatcctcgaggccaagtactggtgccccgactccatggagtacaactgccccaacctgagcccccgcgaggagcccgacgacatcgactgctggtgctacggcgtggagaacgtccgggtggcctacggcaagtgcgactccgcggggcgcagccggcgctcccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggagcaacatgacccagcgcgtggtcatcgcgctgctggtgctcgccgtgggccccgcctactccgcccactgcatcggcatcacggaccgggacttcatcgagggggtccacggcgggacctgggtgagcgcgaccctggagcaggacaagtgcgtgaccgtcatggcccccgacaagccctccctggacatcagcctcgagacggtggccatcgaccgcccggccgaggtgcggaaggtctgctacaacgccgtgctgacccacgtgaagatcaacgacaagtgcccctccaccggcgaggcgcacctggccgaggagaacgagggcgacaacgcctgcaagcgcacctacagcgaccgggggtggggcaacgggtgcggcctcttcgggaagggctccatcgtcgcctgcgccaagttcacgtgcgcgaagagcatgtccctgttcgaggtggaccagaccaagatccagtacgtcatccgcgcccagctgcacgtgggcgccaagcaggagaactggaacaccgacatcaagaccctcaagttcgacgccctgagcgggtcccaggaggtggagttcatcggctacgggaaggccacgctggagtgccaggtccagaccgcggtggacttcggcaacagctacatcgccgagatggagaccgagagctggatcgtggaccggcagtgggcccaggacctcaccctgccctggcagtccgggagcggcggcgtctggcgcgagatgcaccacctggtggagttcgagcccccgcacgccgccacgatccgcgtgctcgcgctggggaaccaggagggctccctgaagaccgccctcaccggggccatgcgggtcaccaaggacacgaacgacaacaacctgtacaagctgcacggcgggcacgtgagctgccgcgtgaagctctccgccctgaccctgaagggcaccagctacaagatctgcaccgacaagatgttcttcgtcaagaaccccacggacaccggccacgggaccgtggtgatgcaggtcaaggtgtccaagggcgcgccctgccggatcccggtgatcgtcgccgacgacctcaccgccgccatcaacaaggggatcctggtgaccgtgaacccgatcgccagcacgaacgacgacgaggtcctgatcgaggtgaacccgcccttcggcgactcctacatcatcgtgggccgcggggacagccggctcacctaccagtggcacaaggagggctccagcatcgggaagctgttcacccagaccatgaagggcgtcgagcgcctggcggtgatgggggacacggcctgggacttctccagcgccggcggcttcttcacctccgtggggaagggcatccacaccgtcttcgggagcgccttccagggcctgttcgggggcctcaactggatcaccaaggtgatcatgggcgccgtgctgatctgggtcgggatcaacacgcggaacatgaccatgtccatgagcatgatcctggtgggcgtgatcatgatgttcctctccctgggggtcggcgcg

SEQ ID NO: 98 - RNA, 1056 nt, synthetic construct
  misc_feature 1..1056: note = derived and/or modified CDS sequence (opt1) from YFV 17D__NC_002031.1__NS1
  source 1..1056: mol_type = other RNA
gaccagggctgcgccatcaacttcgggaagcgcgagctgaagtgcggcgacgggatcttcatcttccgggacagcgacgactggctcaacaagtactcctactaccccgaggacccggtgaagctggccagcatcgtcaaggcgtccttcgaggagggcaagtgcgggctgaacagcgtggactccctcgagcacgagatgtggcgcagccgggccgacgagatcaacgccatcttcgaggagaacgaggtggacatctccgtcgtggtgcaggaccccaagaacgtctaccagcgcggcacccaccccttcagccggatccgcgacggcctgcagtacgggtggaagacctggggcaagaacctggtgttctcccccgggcggaagaacggcagcttcatcatcgacgggaagtcccgcaaggagtgcccgttcagcaaccgggtgtggaactccttccagatcgaggagttcggcacgggcgtcttcaccacccgcgtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccggagcatcgggggcccggtcagctcccacaaccacatccccgggtacaaggtgcagaccaacggcccctggatgcaggtgcccctggaggtcaagcgcgaggcctgcccgggcaccagcgtgatcatcgacgggaactgcgacggccgggggaagtccacgcgcagcaccaccgactccggcaaggtgatccccgagtggtgctgccggagctgcaccatgccgcccgtctccttccacgggagcgacggctgctggtaccccatggagatccgcccccggaagacgcacgagtcccacctggtgcgcagctgggtgaccgcg

SEQ ID NO: 99 - RNA, 672 nt, synthetic construct
  misc_feature 1..672: note = derived and/or modified CDS sequence (opt1) from YFV 17D__NC_002031.1__NS2A
  source 1..672: mol_type = other RNA
ggcgagatccacgccgtgcccttcgggctggtcagcatgatgatcgccatggaggtggtgctccgcaagcggcagggcccgaagcagatgctggtcgggggcgtggtgctgctcggggcgatgctggtcggccaggtgaccctgctcgacctgctgaagctcaccgtggccgtcggcctgcacttccacgagatgaacaacgggggcgacgccatgtacatggccctgatcgccgcgttctccatccgccccgggctcctgatcggcttcgggctgcggacgctctggagcccccgcgagcggctggtgctgaccctcggcgccgccatggtggagatcgccctgggcggggtcatgggcgggctgtggaagtacctcaacgcggtgtccctgtgcatcctgaccatcaacgccgtggccagccgcaaggcctccaacaccatcctccccctgatggccctgctcacgccggtcaccatggcggaggtgcggctggccgccatgttcttctgcgccgtggtcatcatcggcgtgctgcaccagaacttcaaggacaccagcatgcagaagaccatccccctcgtggccctgacgctgacctcctacctcggcctgacccagcccttcctggggctctgcgcgttcctggccacccgcatcttcggccggcgc

SEQ ID NO: 100 - RNA, 390 nt, synthetic construct
  misc_feature 1..390: note = derived and/or modified CDS sequence (opt1) from YFV 17D__NC_002031.1__NS2B
  source 1..390: mol_type = other RNA
agcatccccgtgaacgaggccctggccgcggccggcctcgtcggggtgctggccggcctggccttccaggagatggagaacttcctcgggccgatcgccgtgggcgggctgctgatgatgctcgtctccgtggcgggccgcgtggacggcctggagctgaagaagctcggggaggtcagctgggaggaggaggccgagatctccggcagctccgcccggtacgacgtggccctgagcgagcagggggagttcaagctgctctccgaggagaaggtgccctgggaccaggtcgtgatgaccagcctggcgctggtgggcgccgccctccaccccttcgccctgctgctcgtcctggccgggtggctgttccacgtgcgcggcgcgcggcgc

SEQ ID NO: 101 - RNA, 1869 nt, synthetic construct
  misc_feature 1..1869: note = derived and/or modified CDS sequence (opt1) from YFV 17D__NC_002031.1__NS3
  source 1..1869: mol_type = other RNA
agcggcgacgtgctgtgggacatccccaccccgaagatcatcgaggagtgcgagcacctcgaggacgggatctacggcatcttccagtccaccttcctgggggccagccagcgcggcgtcggggtggcccagggcggcgtgttccacacgatgtggcacgtcacccggggcgcgttcctggtgcgcaacgggaagaagctcatcccctcctgggccagcgtgaaggaggacctggtcgcctacgggggctcctggaagctggaggggcggtgggacggcgaggaggaggtgcagctcatcgccgccgtgcccggcaagaacgtcgtgaacgtgcagaccaagcccagcctgttcaaggtccgcaacgggggcgagatcggggcggtggccctggactacccgtccggcaccagcggctcccccatcgtgaaccggaacggggaggtcatcggcctctacgggaacggcatcctggtgggggacaacagcttcgtgtccgccatcagccagacggaggtcaaggaggagggcaaggaggagctgcaggagatccccaccatgctcaagaagggcatgaccaccgtgctggacttccaccccggggccggcaagacgcgccggttcctgccgcagatcctcgcggagtgcgcccgccggcgcctgcggaccctggtgctcgcccccacccgcgtcgtgctgtccgagatgaaggaggccttccacgggctggacgtgaagttccacacccaggccttcagcgcgcacggctccgggcgggaggtcatcgacgccatgtgccacgccacgctcacctaccgcatgctggagcccacccgggtggtcaactgggaggtgatcatcatggacgaggcccacttcctggaccccgccagcatcgcggcccgcggctgggccgcccaccgggcccgcgcgaacgagtccgccaccatcctcatgacggccaccccgcccggcaccagcgacgagttcccccactccaacggggagatcgaggacgtgcagaccgacatccccagcgagccgtggaacacgggccacgactggatcctggccgacaagcggcccaccgcctggttcctgcccagcatccgcgcggccaacgtcatggccgcctccctccggaaggcggggaagagcgtggtggtcctgaaccgcaagaccttcgagcgcgagtaccccaccatcaagcagaagaagccggacttcatcctggccacggacatcgccgagatgggcgccaacctctgcgtggagcgggtgctggactgccgcaccgccttcaagcccgtcctggtggacgaggggcggaaggtggcgatcaagggccccctccgcatctccgccagctccgccgcccagcggcgcggccggatcgggcgcaacccgaaccgggacggcgacagctactactactccgagccgaccagcgagaacaacgcccaccacgtctgctggctggaggcgtccatgctgctcgacaacatggaggtgcgcgggggcatggtggccccgctgtacggcgtcgaggggaccaagacgcccgtgagccccggcgagatgcggctgcgcgacgaccagcggaaggtgttccgcgagctcgtccggaactgcgacctgcccgtgtggctgtcctggcaggtggccaaggccgggctcaagaccaacgaccgcaagtggtgcttcgagggccccgaggagcacgagatcctgaacgacagcggggagaccgtcaagtgccgggcccccggcggcgcgaagaagccgctgcgcccccggtggtgcgacgagcgcgtgtccagcgaccagtccgccctcagcgagttcatcaagttcgccgaggggcgccgg

SEQ ID NO: 102 - RNA, 447 nt, synthetic construct
  misc_feature 1..447: note = derived and/or modified CDS sequence (opt1) from YFV 17D__NC_002031.1__NS4A-P2K
  source 1..447: mol_type = other RNA
ggcgccgccgaggtgctggtcgtgctcagcgagctgcccgacttcctggcgaagaagggcggcgaggccatggacaccatctccgtgttcctccacagcgaggaggggtcccgcgcctaccggaacgccctgagcatgatgccggaggccatgaccatcgtcatgctgttcatcctcgcggggctgctgacgtccgggatggtgatcttcttcatgagccccaagggcatctcccgcatgagcatggccatgggcaccatggccgggtgcgggtacctcatgttcctgggcggcgtgaagcccacccacatctcctacgtcatgctgatcttcttcgtgctcatggtggtcgtgatccccgagccggggcagcagcggagcatccaggacaaccaggtggcctacctgatcatcggcatcctcaccctggtctccgccgtggcggcc

SEQ ID NO: 103 - RNA, 750 nt, synthetic construct
  misc_feature 1..750: note = derived and/or modified CDS sequence (opt1) from YFV 17D__NC_002031.1__NS4B
  source 1..750: mol_type = other RNA
aacgagctgggcatgctcgagaagaccaaggaggacctgttcgggaagaagaacctgatccccagctccgccagcccgtggtcctggcccgacctcgacctgaagcccggcgccgcgtggaccgtgtacgtcgggatcgtgacgatgctgagccccatgctccaccactggatcaaggtggagtacggcaacctgtccctgagcgggatcgcccagtccgccagcgtcctctccttcatggacaagggcatcccgttcatgaagatgaacatcagcgtgatcatgctgctggtgtccggctggaacagcatcaccgtcatgcccctcctgtgcgggatcggctgcgccatgctgcactggtccctcatcctgcccgggatcaaggcccagcagagcaagctggcgcagcgccgggtgttccacggcgtggccgagaaccccgtcgtggacgggaacccgaccgtggacatcgaggaggcccccgagatgcccgccctctacgagaagaagctggcgctgtacctcctgctggccctctccctggccagcgtcgccatgtgccgcacccccttctccctggccgagggcatcgtgctcgcgagcgccgccctgggcccgctgatcgaggggaacacgtccctcctgtggaacggccccatggccgtgagcatgaccggggtcatgcggggcaaccactacgccttcgtgggcgtgatgtacaacctgtggaagatgaagaccgggcgccgg

SEQ ID NO: 104 - RNA, 2715 nt, synthetic construct
  misc_feature 1..2715: note = derived and/or modified CDS sequence (opt1) from YFV 17D__NC_002031.1__NS5
  source 1..2715: mol_type = other RNA
ggcagcgccaacgggaagaccctgggcgaggtgtggaagcgcgagctcaacctgctggacaagcggcagttcgagctctacaagcgcaccgacatcgtcgaggtggaccgggacacggcccgccggcacctggcggaggggaaggtggacaccggcgtcgccgtgtcccgcgggaccgccaagctgcggtggttccacgagcgcggctacgtgaagctcgagggccgggtcatcgacctggggtgcggccgcgggggctggtgctactacgccgccgcgcagaaggaggtgagcggggtgaagggcttcaccctgggccgggacgggcacgagaagcccatgaacgtccagtccctcggctggaacatcatcacgttcaaggacaagaccgacatccaccgcctggagccggtgaagtgcgacaccctgctctgcgacatcggggagagctccagctccagcgtgaccgagggcgagcggacggtccgcgtgctggacaccgtggagaagtggctggcctgcggcgtcgacaacttctgcgtgaaggtgctcgccccctacatgcccgacgtcctggagaagctggagctcctgcagcggcgcttcgggggcaccgtgatccggaaccccctgtcccgcaacagcacccacgagatgtactacgtgtccggggcccggagcaacgtcacgttcaccgtgaaccagacctcccgcctcctgatgcggcgcatgcgccggccgaccggcaaggtgacgctggaggcggacgtcatcctccccatcgggacccgcagcgtggagaccgacaagggccccctggacaaggaggccatcgaggagcgggtcgagcgcatcaagtccgagtacatgaccagctggttctacgacaacgacaacccctaccggacgtggcactactgcggctcctacgtgaccaagaccagcgggtccgccgccagcatggtgaacggcgtcatcaagatcctgacctacccgtgggaccgcatcgaggaggtgacgcggatggccatgaccgacaccacccccttcgggcagcagcgcgtgttcaaggagaaggtcgacacgcgggcgaaggacccgcccgccggcacccgcaagatcatgaaggtggtgaaccggtggctcttccgccacctggcccgggagaagaacccccgcctgtgcaccaaggaggagttcatcgccaaggtccggagccacgccgcgatcggggcctacctcgaggagcaggagcagtggaagaccgccaacgaggccgtgcaggaccccaagttctgggagctggtggacgaggagcgcaagctgcaccagcagggccggtgccgcacgtgcgtctacaacatgatgggcaagcgggagaagaagctctccgagttcgggaaggccaagggcagccgcgcgatctggtacatgtggctgggggcccgctacctggagttcgaggccctcggcttcctgaacgaggaccactgggcctcccgggagaacagcgggggcggcgtggaggggatcggcctgcagtacctcgggtacgtgatccgcgacctggccgcgatggacggcggcgggttctacgccgacgacaccgccggctgggacacccggatcaccgaggccgacctggacgacgagcaggagatcctcaactacatgtccccgcaccacaagaagctggcgcaggccgtcatggagatgacgtacaagaacaaggtggtgaaggtcctgcgccccgccccgggcgggaaggcctacatggacgtgatcagccggcgcgaccagcgggggtccggccaggtggtcacctacgccctcaacaccatcaccaacctgaaggtgcagctgatccgcatggcggaggccgagatggtgatccaccaccagcacgtccaggactgcgacgagagcgtgctgacccggctcgaggcctggctgacggagcacggctgcgaccgcctgaagcggatggccgtgtccggggacgactgcgtcgtgcgccccatcgacgaccggttcggcctcgccctgagccacctgaacgcgatgtccaaggtgcgcaaggacatcagcgagtggcagccctccaaggggtggaacgactgggagaacgtccccttctgcagccaccacttccacgagctccagctgaaggacggccggcgcatcgtggtgccgtgccgggagcaggacgagctgatcgggcgcggccgggtctcccccggcaacgggtggatgatcaaggagaccgcctgcctcagcaaggcctacgccaacatgtggtccctgatgtacttccacaagcgcgacatgcggctgctcagcctggccgtgtccagcgcggtgcccaccagctgggtcccccagggccgcaccacgtggtccatccacgggaagggcgagtggatgaccaccgaggacatgctggaggtgtggaaccgcgtgtggatcaccaacaacccgcacatgcaggacaagacgatggtcaagaagtggcgggacgtgccctacctcaccaagcgccaggacaagctgtgcgggagcctgatcggcatgaccaaccgggccacctgggcctcccacatccacctcgtgatccaccgcatccggacgctgatcggccaggagaagtacaccgactacctgaccgtcatggaccgctacagcgtggacgccgacctccagctgggggagctgatc

SEQ ID NO: 105 - RNA, 2334 nt, synthetic construct
  misc_feature 1..2334: note = derived and/or modified CDS sequence (opt1) from YFV 17D__NC_002031.1__C-prME
  source 1..2334: mol_type = other RNA
atgagcggccggaaggcccaggggaagaccctgggcgtgaacatggtccgccggggcgtgcgctccctcagcaacaagatcaagcagaagaccaagcagatcgggaaccggcccgggccgtcccgcggcgtgcagggcttcatcttcttcttcctgttcaacatcctgacggggaagaagatcaccgcccacctcaagcggctgtggaagatgctggacccccgccagggcctcgcggtcctgcggaaggtgaagcgcgtggtcgccagcctgatgcgggggctctccagccgcaagcggcgcagccacgacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgcc

SEQ ID NO: 106 - RNA, 3390 nt, synthetic construct
  misc_feature 1..3390: note = derived and/or modified CDS sequence (opt1) from YFV 17D__NC_002031.1__C-prME-NS1
  source 1..3390: mol_type = other RNA
atgagcggccggaaggcccaggggaagaccctgggcgtgaacatggtccgccggggcgtgcgctccctcagcaacaagatcaagcagaagaccaagcagatcgggaaccggcccgggccgtcccgcggcgtgcagggcttcatcttcttcttcctgttcaacatcctgacggggaagaagatcaccgcccacctcaagcggctgtggaagatgctggacccccgccagggcctcgcggtcctgcggaaggtgaagcgcgtggtcgccagcctgatgcgggggctctccagccgcaagcggcgcagccacgacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgccgaccagggctgcgccatcaacttcgggaagcgggagctgaagtgcggcgacgggatcttcatcttccgcgacagcgacgactggctcaacaagtactcctactaccccgaggacccggtgaagctggccagcatcgtcaaggcgtccttcgaggagggcaagtgcgggctgaacagcgtggactccctcgagcacgagatgtggcggagccgcgccgacgagatcaacgccatcttcgaggagaacgaggtggacatctccgtcgtggtgcaggaccccaagaacgtctaccagcggggcacccaccccttcagccgcatccgggacggcctgcagtacgggtggaagacctggggcaagaacctggtgttctcccccgggcgcaagaacggcagcttcatcatcgacgggaagtcccggaaggagtgcccgttcagcaaccgcgtgtggaactccttccagatcgaggagttcggcacgggcgtcttcaccacccgggtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccgcagcatcgggggcccggtcagctcccacaaccacatccccgggtacaaggtgcagaccaacggcccctggatgcaggtgcccctggaggtcaagcgggaggcctgcccgggcaccagcgtgatcatcgacgggaactgcgacggccgcgggaagtccacgcggagcaccaccgactccggcaaggtgatccccgagtggtgctgccgcagctgcaccatgccgcccgtctccttccacgggagcgacggctgctggtacccgatggagatccggccccgcaagacgcacgagtcccacctggtgcggagctgggtgaccgcg

SEQ ID NO: 107 - RNA, 30 nt, synthetic construct
  misc_feature 1..30: note = derived and/or modified CDS sequence (opt1) from YFV 17D__NC_002031.1__X or 10aa (5'-terminus)
  source 1..30: mol_type = other RNA
atgcggggcctgagctcccgcaagcggcgc

SEQ ID NO: 108 - RNA, 30 nt, synthetic construct
  misc_feature 1..30: note = derived and/or modified CDS sequence (opt1) from YFV 17D__NC_002031.1__X or 10aa (5'-terminus)
  source 1..30: mol_type = other RNA
atgcgggggctctccagccgcaagcggcgc

SEQ ID NO: 109 - RNA, 30 nt, synthetic construct
  misc_feature 1..30: note = derived and/or modified CDS sequence (opt1) from YFV 17D__NC_002031.1__X or 10aa (5'-terminus)
  source 1..30: mol_type = other RNA
atgcgcgggctctccagccggaagcgccgg

SEQ ID NO: 110 - RNA, 60 nt, synthetic construct
  misc_feature 1..60: note = derived and/or modified CDS sequence (opt1) from YFV 17D__NC_002031.1__SS or ER anchor (v1)
  source 1..60: mol_type = other RNA
agccacgacgtgctcaccgtccagttcctgatcctggggatgctcctgatgaccggcggg

SEQ ID NO: 111 - RNA, 54 nt, synthetic construct
  misc_feature 1..54: note = derived and/or modified CDS sequence (opt1) from YFV 17D__NC_002031.1__SS or ER anchor (v2)
  source 1..54: mol_type = other RNA
gacgtgctgaccgtccagttcctcatcctgggcatgctgctcatgaccgggggc

SEQ ID NO: 112 - RNA, 60 nt, synthetic construct
  misc_feature 1..60: note = derived and/or modified CDS sequence (opt1) from YFV 17D__NC_002031.1__SS or ER anchor (v1)
  source 1..60: mol_type = other RNA
tcccacgacgtgctgaccgtgcagttcctgatcctcggcatgctgctgatgaccgggggc

SEQ ID NO: 113 - RNA, 72 nt, synthetic construct
  misc_feature 1..72: note = derived and/or modified CDS sequence (opt1) from YFV 17D__NC_002031.1__SS or ER anchor (v4)
  source 1..72: mol_type = other RNA
agccacgacgtgctcaccgtccagttcctgatcctggggatgctcctgatgaccggcggggtgacgctggtg

SEQ ID NO: 114 - RNA, 90 nt, synthetic construct
  misc_feature 1..90: note = derived and/or modified CDS sequence (opt1) from YFV 17D__NC_002031.1__X-SS or 10aa (5'-terminus)-SS (v1)
  source 1..90: mol_type = other RNA
atgcggggcctgagctcccgcaagcggcgcagccacgacgtgctcaccgtccagttcctgatcctggggatgctcctgatgaccggcggg

SEQ ID NO: 115 - RNA, 90 nt, synthetic construct
  misc_feature 1..90: note = derived and/or modified CDS sequence (opt1) from YFV 17D__NC_002031.1__X-SS or 10aa (5'-terminus)-SS (v1)
  source 1..90: mol_type = other RNA
atgcgcgggctctccagccggaagcgccggtcccacgacgtgctgaccgtgcagttcctgatcctcggcatgctgctgatgaccgggggc

SEQ ID NO: 116 - RNA, 102 nt, synthetic construct
  misc_feature 1..102: note = derived and/or modified CDS sequence (opt1) from YFV 17D__NC_002031.1__X-SS or 10aa (5'-terminus)-SS (v2)
  source 1..102: mol_type = other RNA
atgcggggcctgagctcccgcaagcggcgcagccacgacgtgctcaccgtccagttcctgatcctggggatgctcctgatgaccggcggggtgacgctggtg

SEQ ID NO: 117 - RNA, 30 nt, synthetic construct
  misc_feature 1..30: note = derived and/or modified CDS sequence (opt1) from YFV 17D__NC_002031.1__XX or 10aa (3'-terminus)
  source 1..30: mol_type = other RNA
gaccagggctgcgccatcaacttcggcaag

SEQ ID NO: 118 - RNA, 30 nt, synthetic construct
  misc_feature 1..30: note = derived and/or modified CDS sequence (opt1) from YFV 17D__NC_002031.1__XX or 10aa (3'-terminus)
  source 1..30: mol_type = other RNA
gaccagggctgcgccatcaacttcgggaag

SEQ ID NO: 119 - RNA, 30 nt, synthetic construct
  misc_feature 1..30: note = derived and/or modified CDS sequence (opt1) from YFV 17D__NC_002031.1__XX or 10aa (3'-terminus)
  source 1..30: mol_type = other RNA
gaccagggctgcgcgatcaacttcgggaag

SEQ ID NO: 120 - RNA, 2091 nt, synthetic construct
  misc_feature 1..2091: note = derived and/or modified CDS sequence (opt1) from YFV 17D__NC_002031.1__X-SS-prME-XX
  source 1..2091: mol_type = other RNA
atgcggggcctgagctcccgcaagcggcgcagccacgacgtgctcaccgtccagttcctgatcctggggatgctcctgatgaccggcggggtgacgctggtgcggaagaaccgctggctcctgctgaacgtcacctccgaggacctcggcaagaccttcagcgtggggaccggcaactgcacgaccaacatcctggaggccaagtactggtgccccgactccatggagtacaactgcccgaacctgagcccccgggaggagcccgacgacatcgactgctggtgctacggcgtggagaacgtccgcgtggcctacgggaagtgcgactccgcgggccggagccgccggtcccgccgggccatcgacctccccacccacgagaaccacgggctgaagacccgccaggagaagtggatgacgggccggatgggggagcgccagctgcagaagatcgagcggtggttcgtgcgcaacccgttcttcgccgtcaccgccctcaccatcgcctacctggtgggcagcaacatgacccagcgggtggtcatcgcgctgctcgtgctggccgtgggccccgcctactccgcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaag

SEQ ID NO: 121 - RNA, 1581 nt, synthetic construct
  misc_feature 1..1581: note = derived and/or modified CDS sequence (opt1) from YFV 17D__NC_002031.1__X-SS-E
  source 1..1581: mol_type = other RNA
atgcggggcctgagctcccgcaagcggcgcagccacgacgtgctcaccgtccagttcctgatcctggggatgctcctgatgaccggcggggtgacgctggtggcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcg

SEQ ID NO: 122 - RNA, 1611 nt, synthetic construct
  misc_feature 1..1611: note = derived and/or modified CDS sequence (opt1) from YFV 17D__NC_002031.1__X-SS-E-XX
  source 1..1611: mol_type = other RNA
atgcggggcctgagctcccgcaagcggcgcagccacgacgtgctcaccgtccagttcctgatcctggggatgctcctgatgaccggcggggtgacgctggtggcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaag

SEQ ID NO: 123 - RNA, 2025 nt, synthetic construct
  misc_feature 1..2025: note = derived and/or modified CDS sequence (opt1) from YFV 17D__NC_002031.1__SS-prME
  source 1..2025: mol_type = other RNA
gacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgcc

SEQ ID NO: 124 - RNA, 3081 nt, synthetic construct
  misc_feature 1..3081: note = derived and/or modified CDS sequence (opt1) from YFV 17D__NC_002031.1__SS-prME-NS1
  source 1..3081: mol_type = other RNA
gacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgccgaccagggctgcgccatcaacttcgggaagcgggagctgaagtgcggcgacgggatcttcatcttccgcgacagcgacgactggctcaacaagtactcctactaccccgaggacccggtgaagctggccagcatcgtcaaggcgtccttcgaggagggcaagtgcgggctgaacagcgtggactccctcgagcacgagatgtggcggagccgcgccgacgagatcaacgccatcttcgaggagaacgaggtggacatctccgtcgtggtgcaggaccccaagaacgtctaccagcggggcacccaccccttcagccgcatccgggacggcctgcagtacgggtggaagacctggggcaagaacctggtgttctcccccgggcgcaagaacggcagcttcatcatcgacgggaagtcccggaaggagtgcccgttcagcaaccgcgtgtggaactccttccagatcgaggagttcggcacgggcgtcttcaccacccgggtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccgcagcatcgggggcccggtcagctcccacaaccacatccccgggtacaaggtgcagaccaacggcccctggatgcaggtgcccctggaggtcaagcgggaggcctgcccgggcaccagcgtgatcatcgacgggaactgcgacggccgcgggaagtccacgcggagcaccaccgactccggcaaggtgatccccgagtggtgctgccgcagctgcaccatgccgcccgtctccttccacgggagcgacggctgctggtacccgatggagatccggccccgcaagacgcacgagtcccacctggtgcggagctgggtgaccgcg

SEQ ID NO: 125 - RNA, 273 nt, synthetic construct
  misc_feature 1..273: note = derived and/or modified CDS sequence (opt1) from YFV 17D__NC_002031.1__C (without X-SS)
  source 1..273: mol_type = other RNA
atgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctg

SEQ ID NO: 126 - RNA, 1026 nt, synthetic construct
  misc_feature 1..1026: note = derived and/or modified CDS sequence (opt1) from YFV 17D__NC_002031.1__NS1 (without XX)
  source 1..1026: mol_type = other RNA
cgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagagcgcccacgggtccccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtgcccctcgaggtgaagcgggaggcctgcccgggcaccagcgtcatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtaccccatggagatccggccccgcaagacgcacgagtcccacctggtccggagctgggtgaccgcc

SEQ ID NO: 127 - RNA, 10233 nt, synthetic construct
  misc_feature 1..10233: note = derived and/or modified CDS sequence (opt1) from YFV 17D__NC_002031.1__polyprotein
  source 1..10233: mol_type = other RNA
atgagcgggcgcaaggcccaggggaagaccctgggggtgaacatggtgcggcgcggggtgcggtccctcagcaacaagatcaagcagaagaccaagcagatcggcaaccgccccgggccctcccggggcgtgcagggcttcatcttcttcttcctgttcaacatcctgacggggaagaagatcaccgcccacctcaagcgcctgtggaagatgctggacccccggcagggcctcgccgtgctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaacccgaccgacacgggccacggcaccgtcgtgatgcaggtcaaggtcagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagtccgcccacgggtccccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtccccctcgaggtgaagcgggaggcctgcccgggcaccagcgtcatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtacccgatggagatccggccccgcaagacgcacgagtcccacctggtccggagctgggtgaccgccggcgagatccacgccgtgcccttcgggctggtctccatgatgatcgccatggaggtggtgctccgcaagcggcagggccccaagcagatgctggtcggcggggtggtgctgctcggcgcgatgctggtcggccaggtgaccctgctcgacctgctgaagctcaccgtggccgtcggcctgcacttccacgagatgaacaacgggggcgacgccatgtacatggccctgatcgccgcgttcagcatccgcccgggcctcctgatcgggttcggcctgcgcacgctctggagcccccgggagcgcctggtgctgaccctcggggccgccatggtggagatcgccctgggcggggtcatgggcggcctgtggaagtacctcaacgcggtgtccctgtgcatcctgaccatcaacgccgtggccagccggaaggcctccaacaccatcctccccctgatggccctgctcacccccgtcacgatggcggaggtgcgcctggccgccatgttcttctgcgccgtggtcatcatcggggtgctgcaccagaacttcaaggacaccagcatgcagaagaccatcccgctcgtggccctgaccctgacgtcctacctcggcctgacccagcccttcctggggctctgcgcgttcctggccacccggatcttcggccgccggagcatccccgtcaacgaggccctggccgccgcggggctcgtgggcgtgctggccggcctggccttccaggagatggagaacttcctcgggcccatcgccgtcggcgggctgctgatgatgctcgtgtccgtggccggccgcgtcgacggcctggagctgaagaagctcggggaggtgagctgggaggaggaggcggagatctccggcagctccgcccggtacgacgtggccctgagcgagcagggggagttcaagctgctctccgaggagaaggtcccgtgggaccaggtggtgatgaccagcctggccctggtcggcgcggccctccaccccttcgccctgctgctcgtgctggccgggtggctgttccacgtgcgcggcgcccggcgctccggcgacgtcctctgggacatccccacgcccaagatcatcgaggagtgcgagcacctggaggacgggatctacggcatcttccagagcaccttcctgggggcgtcccagcggggcgtgggggtcgcccagggcggcgtgttccacaccatgtggcacgtgacccgcggggccttcctcgtccggaacggcaagaagctgatcccgagctgggcctccgtgaaggaggacctggtggcctacgggggcagctggaagctcgaggggcgctgggacggcgaggaggaggtccagctgatcgcggccgtgcccggcaagaacgtggtcaacgtgcagacgaagcccagcctgttcaaggtgcggaacgggggcgagatcggggccgtcgccctggactacccgtccggcaccagcgggtcccccatcgtgaaccgcaacggcgaggtgatcggcctctacgggaacggcatcctggtcggggacaacagcttcgtgtccgccatcagccagaccgaggtgaaggaggagggcaaggaggagctgcaggagatccccaccatgctcaagaagggcatgacgaccgtcctggacttccaccccggggcgggcaagacccggcgcttcctgccgcagatcctcgccgagtgcgcccgccggcgcctgcggaccctggtgctcgcccccacgcgcgtggtcctgtccgagatgaaggaggcgttccacgggctggacgtgaagttccacacccaggccttcagcgcccacggctccgggcgggaggtgatcgacgccatgtgccacgccaccctcacctaccgcatgctggagcccacgcgggtcgtgaactgggaggtgatcatcatggacgaggcgcacttcctggaccccgccagcatcgccgcccgcggctgggccgcgcaccgggcccgcgccaacgagtccgccaccatcctcatgaccgccaccccgcccggcacgagcgacgagttcccccactccaacggggagatcgaggacgtccagaccgacatccccagcgagccgtggaacaccggccacgactggatcctggcggacaagcggcccaccgcctggttcctgccctccatccgcgccgccaacgtgatggcggccagcctccggaaggccgggaagtccgtggtcgtgctgaaccgcaagacgttcgagcgggagtaccccaccatcaagcagaagaagccggacttcatcctggccaccgacatcgccgagatgggcgcgaacctctgcgtggagcgcgtcctggactgccggaccgccttcaagcccgtgctggtggacgaggggcgcaaggtcgccatcaagggccccctccggatcagcgcctccagcgccgcgcagcgccggggccgcatcgggcgcaaccccaaccgggacggcgacagctactactactccgagccgacgagcgagaacaacgcccaccacgtgtgctggctggaggcctccatgctgctcgacaacatggaggtgcgcgggggcatggtcgcgcccctgtacggggtggagggcaccaagacccccgtgagccccggcgagatgcggctgcgcgacgaccagcggaaggtcttccgcgagctcgtgcggaactgcgacctgccggtgtggctgtcctggcaggtcgccaaggcggggctcaagaccaacgaccgcaagtggtgcttcgagggccccgaggagcacgagatcctgaacgacagcggggagaccgtgaagtgccgggcccccggcggcgccaagaagcccctgcgcccgcggtggtgcgacgagcgcgtgtccagcgaccagtccgccctcagcgagttcatcaagttcgccgaggggcggcgcggcgcggccgaggtcctggtggtgctgtccgagctccccgacttcctggccaagaagggcggggaggccatggacacgatcagcgtcttcctgcactccgaggaggggagccgggcgtaccgcaacgccctctccatgatgcccgaggccatgaccatcgtgatgctgttcatcctggccggcctcctgaccagcggcatggtcatcttcttcatgtccccgaaggggatcagccggatgtccatggccatgggcaccatggcggggtgcggctacctgatgttcctcgggggcgtgaagcccacgcacatcagctacgtgatgctgatcttcttcgtcctgatggtggtggtcatccccgagcccggccagcagcgcagcatccaggacaaccaggtggcctacctcatcatcgggatcctgaccctggtgtccgccgtcgccgccaacgagctcggcatgctggagaagaccaaggaggacctgttcgggaagaagaacctcatcccgagctccgcgagcccctggtcctggcccgacctggacctgaagcccggcgccgcctggaccgtgtacgtggggatcgtcacgatgctcagcccgatgctgcaccactggatcaaggtggagtacggcaacctgtccctcagcggcatcgcccagtccgccagcgtgctgtccttcatggacaaggggatccccttcatgaagatgaacatcagcgtcatcatgctgctcgtgtccggctggaacagcatcaccgtgatgcccctgctgtgcgggatcggctgcgcgatgctccactggtccctgatcctgcccgggatcaaggcccagcagagcaagctcgcccagcggcgcgtcttccacggcgtggccgagaacccggtggtcgacggcaaccccaccgtggacatcgaggaggcgcccgagatgcccgccctgtacgagaagaagctggccctctacctgctgctcgccctgtccctggccagcgtggcgatgtgccgcaccccgttctccctcgccgaggggatcgtcctggccagcgccgccctgggccccctcatcgaggggaacacgagcctgctgtggaacggccccatggcggtgtccatgaccggcgtgatgcgggggaaccactacgccttcgtcggcgtgatgtacaacctctggaagatgaagaccgggcgccggggcagcgccaacgggaagaccctgggcgaggtgtggaagcgcgagctgaacctcctggacaagcggcagttcgagctgtacaagcgcacggacatcgtcgaggtggaccgggacaccgcccgccggcacctcgccgagggcaaggtggacaccggggtcgcggtgtcccgcggcaccgccaagctgcggtggttccacgagcgcgggtacgtgaagctggagggccgggtcatcgacctcgggtgcggccgcggcgggtggtgctactacgccgccgcgcagaaggaggtgagcggcgtgaaggggttcacgctgggccgggacgggcacgagaagcccatgaacgtccagtccctgggctggaacatcatcaccttcaaggacaagaccgacatccaccgcctcgagccggtgaagtgcgacaccctgctgtgcgacatcggcgagagctccagctccagcgtgacggagggggagcggaccgtccgcgtgctggacaccgtggagaagtggctcgcctgcggcgtcgacaacttctgcgtgaaggtgctggccccctacatgcccgacgtcctggagaagctcgagctgctgcagcggcgcttcgggggcaccgtgatccggaaccccctctcccgcaacagcacgcacgagatgtactacgtgtccggcgcccgcagcaacgtcaccttcaccgtgaaccagacctcccggctgctgatgcgccggatgcgccggccgacggggaaggtcaccctcgaggccgacgtgatcctgcccatcggcacccgcagcgtggagaccgacaaggggcccctggacaaggaggcgatcgaggagcgggtcgagcgcatcaagtccgagtacatgacgagctggttctacgacaacgacaacccctaccggacctggcactactgcggcagctacgtgaccaagacctccgggagcgccgcctccatggtgaacggcgtcatcaagatcctcacgtacccgtgggaccgcatcgaggaggtgacccggatggccatgaccgacaccacccccttcggccagcagcgcgtgttcaaggagaaggtcgacacgcgggccaaggacccgcccgcggggacccgcaagatcatgaaggtggtgaaccggtggctgttccgccacctggcccgggagaagaacccccgcctctgcaccaaggaggagttcatcgccaaggtccggagccacgccgccatcggcgcgtacctggaggagcaggagcagtggaagaccgccaacgaggccgtgcaggaccccaagttctgggagctggtggacgaggagcgcaagctccaccagcaggggcgctgccggacgtgcgtctacaacatgatgggcaagcgcgagaagaagctgtccgagttcgggaaggccaagggcagccgggccatctggtacatgtggctgggcgcgcgctacctcgagttcgaggccctggggttcctgaacgaggaccactgggcctcccgggagaacagcggcgggggcgtggaggggatcggcctccagtacctgggctacgtgatccgcgacctggccgcgatggacgggggcgggttctacgccgacgacaccgccggctgggacacccggatcaccgaggccgacctcgacgacgagcaggagatcctgaactacatgagcccccaccacaagaagctggcccaggcggtcatggagatgacgtacaagaacaaggtggtgaaggtcctccgccccgcccccgggggcaaggcctacatggacgtgatcagccggcgcgaccagcggggctccggccaggtggtcacctacgccctgaacaccatcaccaacctgaaggtgcagctcatccgcatggccgaggcggagatggtgatccaccaccagcacgtccaggactgcgacgagagcgtgctgacgcggctggaggcctggctcaccgagcacggctgcgaccgcctgaagcggatggccgtgtccggggacgactgcgtcgtgcgccccatcgacgaccggttcggcctggccctcagccacctgaacgccatgtccaaggtgcgcaaggacatcagcgagtggcagccctccaagggctggaacgactgggagaacgtcccgttctgcagccaccacttccacgagctgcagctcaaggacgggcggcgcatcgtggtgccctgccgggagcaggacgagctgatcggccgcgggcgcgtctcccccggcaacgggtggatgatcaaggagaccgcgtgcctgagcaaggcctacgccaacatgtggagcctcatgtacttccacaagcgggacatgcgcctgctgtccctcgccgtgagctccgcggtgcccaccagctgggtcccgcagggccggacgacctggtccatccacggcaagggggagtggatgaccaccgaggacatgctggaggtgtggaaccgcgtgtggatcacgaacaacccccacatgcaggacaagaccatggtcaagaagtggcgggacgtgccctacctgaccaagcgccaggacaagctctgcggcagcctgatcgggatgaccaaccgggccacgtgggcctcccacatccacctggtgatccaccgcatccggaccctcatcggccaggagaagtacaccgactacctgaccgtcatggaccgctacagcgtggacgccgacctgcagctcggggagctgatc

SEQ ID NO: 128 - RNA, 303 nt, synthetic construct; identical to SEQ ID NO: 90
  misc_feature 1..303: note = derived and/or modified CDS sequence (opt1) from YFV 17D__NC_002031.1__C
  source 1..303: mol_type = other RNA

SEQ ID NO: 129 - RNA, 363 nt, synthetic construct; identical to SEQ ID NO: 91
  misc_feature 1..363: note = derived and/or modified CDS sequence (opt1) from YFV 17D__NC_002031.1__C-ER anchor
  source 1..363: mol_type = other RNA

SEQ ID NO: 130 - RNA, 267 nt, synthetic construct
  misc_feature 1..267: note = derived and/or modified CDS sequence (opt1) from YFV 17D__NC_002031.1__pr
  source 1..267: mol_type = other RNA
gtgaccctggtccgcaagaaccggtggctcctgctgaacgtgaccagcgaggacctcggcaagacgttctccgtggggaccggcaactgcaccaccaacatcctggaggccaagtactggtgccccgacagcatggagtacaactgcccgaacctgagcccccgcgaggagcccgacgacatcgactgctggtgctacggggtcgagaacgtgcgggtggcctacggcaagtgcgactccgcggggcgctcccggcgcagccggcgc

SEQ ID NO: 131 - RNA, 225 nt, synthetic construct; identical to SEQ ID NO: 93
  misc_feature 1..225: note = derived and/or modified CDS sequence (opt1) from YFV 17D__NC_002031.1__M
  source 1..225: mol_type = other RNA

SEQ ID NO: 132 - RNA, 492 nt, synthetic construct
  misc_feature 1..492: note = derived and/or modified CDS sequence (opt1) from YFV 17D__NC_002031.1__prM
  source 1..492: mol_type = other RNA
gtgaccctggtccgcaagaaccggtggctcctgctgaacgtgaccagcgaggacctcggcaagacgttctccgtggggaccggcaactgcaccaccaacatcctggaggccaagtactggtgccccgacagcatggagtacaactgcccgaacctgagcccccgcgaggagcccgacgacatcgactgctggtgctacggggtcgagaacgtgcgggtggcctacggcaagtgcgactccgcggggcgctcccggcgcagccggcgcgccatcgacctccccacgcacgagaaccacggcctgaagacccggcaggagaagtggatgaccggccgcatgggggagcggcagctgcagaagatcgagcgctggttcgtccggaacccgttcttcgccgtgaccgccctcacgatcgcctacctggtgggctccaacatgacccagcgcgtcgtgatcgcgctgctcgtgctggccgtcgggcccgcctacagc

SEQ ID NO: 133 - RNA, 1479 nt, synthetic construct
  misc_feature 1..1479: note = derived and/or modified CDS sequence (opt1) from YFV 17D__NC_002031.1__E
  source 1..1479: mol_type = other RNA
gcccactgcatcggcatcaccgaccgcgacttcatcgagggggtgcacggcgggacctgggtcagcgccacgctggagcaggacaagtgcgtgaccgtgatggcgcccgacaagccctccctcgacatcagcctggagaccgtcgccatcgaccggcccgccgaggtgcgcaaggtgtgctacaacgccgtcctgacccacgtgaagatcaacgacaagtgcccctccacgggcgaggcccacctcgcggaggagaacgagggggacaacgcctgcaagcggacctacagcgaccgcggctggggcaacgggtgcggcctgttcgggaagggctccatcgtggcctgcgccaagttcacgtgcgccaagagcatgtccctgttcgaggtcgaccagaccaagatccagtacgtgatccgggcgcagctccacgtgggggccaagcaggagaactggaacaccgacatcaagaccctgaagttcgacgccctgagcggctcccaggaggtcgagttcatcggctacgggaaggccaccctcgagtgccaggtgcagaccgcggtggacttcggcaacagctacatcgccgagatggagacggagtcctggatcgtcgaccgccagtgggcccaggacctgaccctgccctggcagagcgggtccggcggcgtgtggcgggagatgcaccacctcgtggagttcgagccgccccacgccgccaccatccgcgtcctggcgctggggaaccaggagggcagcctcaagaccgccctgacgggggccatgcgggtgaccaaggacaccaacgacaacaacctgtacaagctccacggcgggcacgtgtcctgccgcgtcaagctgagcgccctgaccctcaagggcacgtcctacaagatctgcaccgacaagatgttcttcgtgaagaaccccaccgacaccggccacgggacggtggtcatgcaggtcaaggtgagcaagggcgccccctgccggatcccggtgatcgtggcggacgacctgaccgccgccatcaacaaggggatcctggtcaccgtgaaccccatcgcctccaccaacgacgacgaggtgctcatcgaggtcaacccgcccttcggcgacagctacatcatcgtggggcgcggcgacagccggctgacgtaccagtggcacaaggagggctccagcatcgggaagctgttcacccagaccatgaagggcgtggagcgcctcgccgtcatgggggacaccgcgtgggacttctccagcgccggcgggttcttcacgtccgtgggcaagggcatccacaccgtgttcgggagcgccttccagggcctgttcgggggcctgaactggatcaccaaggtcatcatgggcgccgtgctcatctgggtggggatcaacacccggaacatgacgatgtccatgagcatgatcctggtcggcgtgatcatgatgttcctgtccctcggggtgggcgcg

SEQ ID NO: 134 - RNA, 1971 nt, synthetic construct
  misc_feature 1..1971: note = derived and/or modified CDS sequence (opt1) from YFV 17D__NC_002031.1__prME
  source 1..1971: mol_type = other RNA
gtgaccctggtccgcaagaaccggtggctcctgctgaacgtgaccagcgaggacctcggcaagacgttctccgtggggaccggcaactgcaccaccaacatcctggaggccaagtactggtgccccgacagcatggagtacaactgccccaacctgagcccccgcgaggagcccgacgacatcgactgctggtgctacggggtcgagaacgtgcgggtggcctacggcaagtgcgactccgcggggcgctcccggcgcagccggcgcgccatcgacctccccacgcacgagaaccacggcctgaagacccggcaggagaagtggatgaccggccgcatgggggagcggcagctgcagaagatcgagcgctggttcgtccggaacccgttcttcgccgtgaccgccctcacgatcgcctacctggtgggctccaacatgacccagcgcgtcgtgatcgcgctgctcgtgctggccgtcgggcccgcctacagcgcccactgcatcggcatcaccgaccgggacttcatcgagggggtgcacggcggcacctgggtgtccgcgacgctggagcaggacaagtgcgtcaccgtgatggcccccgacaagcccagcctcgacatctccctggagaccgtggccatcgaccgcccggccgaggtccggaaggtgtgctacaacgccgtgctgacccacgtcaagatcaacgacaagtgccccagcacgggggaggcgcacctcgccgaggagaacgagggcgacaacgcctgcaagcgcacctactccgaccgggggtggggcaacggctgcgggctgttcggcaaggggagcatcgtggcctgcgccaagttcacgtgcgcgaagtccatgagcctgttcgaggtggaccagaccaagatccagtacgtcatccgcgcccagctccacgtgggcgccaagcaggagaactggaacaccgacatcaagaccctgaagttcgacgccctgtccgggagccaggaggtcgagttcatcggctacggcaaggccaccctcgagtgccaggtgcagaccgcggtggacttcgggaactcctacatcgccgagatggagacggagagctggatcgtcgaccggcagtgggcccaggacctgaccctgccctggcagagcggctccgggggcgtgtggcgcgagatgcaccacctcgtggagttcgagcccccgcacgccgccaccatccgcgtcctggcgctggggaaccaggagggcagcctcaagaccgccctgacgggcgccatgcgggtgaccaaggacaccaacgacaacaacctgtacaagctccacgggggccacgtgtcctgccgcgtcaagctgagcgccctgaccctcaaggggacgtcctacaagatctgcaccgacaagatgttcttcgtgaagaaccccaccgacaccggccacgggacggtggtcatgcaggtcaaggtgagcaagggcgcgccctgccggatccccgtgatcgtggccgacgacctgaccgccgccatcaacaagggcatcctggtgaccgtcaacccgatcgcctccaccaacgacgacgaggtgctcatcgaggtgaacccgcccttcggggacagctacatcatcgtcggccgcggggactcccggctgacctaccagtggcacaaggagggcagctccatcggcaagctgttcacgcagaccatgaagggggtggagcgcctcgcggtgatgggcgacaccgcctgggacttcagctccgccgggggcttcttcaccagcgtcgggaagggcatccacacggtgttcggctccgccttccaggggctgttcggcgggctgaactggatcaccaaggtgatcatgggcgccgtcctcatctgggtggggatcaacacccggaacatgaccatgagcatgtccatgatcctggtgggcgtcatcatgatgttcctgagcctcggcgtgggggcg

SEQ ID NO: 135 - RNA, 2031 nt, synthetic construct
  misc_feature 1..2031: note = derived and/or modified CDS sequence (opt1) from YFV 17D__NC_002031.1__ER anchor-prME
  source 1..2031: mol_type = other RNA
agccacgacgtgctgaccgtccagttcctcatcctgggcatgctgctcatgaccgggggcgtgacgctggtgcgcaagaaccggtggctgctcctgaacgtcacctccgaggacctggggaagaccttcagcgtgggcaccgggaactgcacgaccaacatcctcgaggccaagtactggtgccccgactccatggagtacaactgccccaacctgagcccccgcgaggagcccgacgacatcgactgctggtgctacggcgtggagaacgtccgggtggcctacggcaagtgcgactccgcggggcgcagccggcgctcccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggagcaacatgacccagcgcgtggtcatcgcgctgctggtgctcgccgtgggccccgcctactccgcccactgcatcggcatcacggaccgggacttcatcgagggggtccacggcgggacctgggtgagcgcgaccctggagcaggacaagtgcgtgaccgtcatggcccccgacaagccctccctggacatcagcctcgagacggtggccatcgaccgcccggccgaggtgcggaaggtctgctacaacgccgtgctgacccacgtgaagatcaacgacaagtgcccctccaccggcgaggcgcacctggccgaggagaacgagggcgacaacgcctgcaagcgcacctacagcgaccgggggtggggcaacgggtgcggcctcttcgggaagggctccatcgtcgcctgcgccaagttcacgtgcgccaagagcatgtccctgttcgaggtggaccagaccaagatccagtacgtcatccgcgcgcagctgcacgtgggcgccaagcaggagaactggaacaccgacatcaagaccctcaagttcgacgccctgagcgggtcccaggaggtggagttcatcggctacgggaaggccacgctggagtgccaggtccagaccgcggtggacttcggcaacagctacatcgccgagatggagaccgagagctggatcgtggaccggcagtgggcccaggacctcaccctgccctggcagtccgggagcggcggcgtctggcgcgagatgcaccacctggtggagttcgagcccccgcacgccgccacgatccgcgtgctcgcgctggggaaccaggagggctccctgaagaccgccctcaccggggccatgcgggtcaccaaggacacgaacgacaacaacctgtacaagctgcacggcgggcacgtgagctgccgcgtgaagctctccgccctgaccctgaagggcaccagctacaagatctgcaccgacaagatgttcttcgtcaagaaccccacggacaccggccacgggaccgtggtgatgcaggtcaaggtgtccaagggcgcgccctgccggatccccgtgatcgtcgccgacgacctcaccgccgccatcaacaaggggatcctggtgaccgtgaacccgatcgccagcacgaacgacgacgaggtcctgatcgaggtgaacccgcccttcggcgactcctacatcatcgtgggccgcggggacagccggctcacctaccagtggcacaaggagggctccagcatcgggaagctgttcacccagaccatgaagggcgtcgagcgcctggcggtgatgggggacacggcctgggacttctccagcgccggcggcttcttcacctccgtggggaagggcatccacaccgtcttcgggagcgccttccagggcctcttcgggggcctgaactggatcaccaaggtgatcatgggcgccgtgctgatctgggtcgggatcaacacgcggaacatgaccatgtccatgagcatgatcctggtgggcgtgatcatgatgttcctctccctgggggtcggcgcg

SEQ ID NO: 136 - RNA, 1056 nt, synthetic construct
  misc_feature 1..1056: note = derived and/or modified CDS sequence (opt1) from YFV 17D__NC_002031.1__NS1
  source 1..1056: mol_type = other RNA
gaccagggctgcgccatcaacttcgggaagcgcgagctgaagtgcggcgacgggatcttcatcttccgggacagcgacgactggctcaacaagtactcctactaccccgaggacccggtgaagctggccagcatcgtcaaggcgtccttcgaggagggcaagtgcgggctgaacagcgtggactccctcgagcacgagatgtggcgcagccgggccgacgagatcaacgccatcttcgaggagaacgaggtggacatctccgtcgtggtgcaggaccccaagaacgtctaccagcgcggcacccaccccttcagccggatccgcgacggcctgcagtacgggtggaagacctggggcaagaacctggtgttctcccccgggcggaagaacggcagcttcatcatcgacgggaagtcccgcaaggagtgcccgttcagcaaccgggtgtggaactccttccagatcgaggagttcggcacgggcgtcttcaccacccgcgtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccggagcatcgggggcccggtcagctcccacaaccacatccccgggtacaaggtgcagaccaacggcccctggatgcaggtccccctggaggtgaagcgcgaggcctgcccgggcaccagcgtgatcatcgacgggaactgcgacggccgggggaagtccacgcgcagcaccaccgactccggcaaggtgatccccgagtggtgctgccggagctgcaccatgccgcccgtctccttccacgggagcgacggctgctggtaccccatggagatccgcccccggaagacgcacgagtcccacctggtgcgcagctgggtgaccgcg

SEQ ID NO: 137 - RNA, 672 nt, synthetic construct; identical to SEQ ID NO: 99
  misc_feature 1..672: note = derived and/or modified CDS sequence (opt1) from YFV 17D__NC_002031.1__NS2A
  source 1..672: mol_type = other RNA

SEQ ID NO: 138 - RNA, 390 nt, synthetic construct; identical to SEQ ID NO: 100
  misc_feature 1..390: note = derived and/or modified CDS sequence (opt1) from YFV 17D__NC_002031.1__NS2B
  source 1..390: mol_type = other RNA

SEQ ID NO: 139 - RNA, 1869 nt, synthetic construct
  misc_feature 1..1869: note = derived and/or modified CDS sequence (opt1) from YFV 17D__NC_002031.1__NS3
  source 1..1869: mol_type = other RNA
agcggcgacgtgctgtgggacatccccaccccgaagatcatcgaggagtgcgagcacctcgaggacgggatctacggcatcttccagtccaccttcctgggggccagccagcgcggcgtcggggtggcccagggcggcgtgttccacacgatgtggcacgtcacccgcggggcgttcctggtgcggaacggcaagaagctcatcccctcctgggccagcgtgaaggaggacctggtcgcctacgggggctcctggaagctggaggggcggtgggacggcgaggaggaggtgcagctcatcgccgccgtgcccggcaagaacgtcgtgaacgtgcagaccaagcccagcctgttcaaggtccgcaacgggggcgagatcggggcggtggccctggactacccgtccggcaccagcggctcccccatcgtgaaccggaacggggaggtcatcggcctctacgggaacggcatcctggtgggggacaacagcttcgtgtccgccatcagccagacggaggtcaaggaggagggcaaggaggagctgcaggagatccccaccatgctcaagaagggcatgaccaccgtgctggacttccaccccggggccggcaagacgcgccggttcctgccgcagatcctcgcggagtgcgcccgccggcgcctgcggaccctggtgctcgcccccacccgcgtcgtgctgtccgagatgaaggaggccttccacgggctggacgtgaagttccacacccaggccttcagcgcgcacggctccgggcgggaggtcatcgacgccatgtgccacgccacgctcacctaccgcatgctggagcccacccgggtggtcaactgggaggtgatcatcatggacgaggcccacttcctggaccccgccagcatcgcggcccgcggctgggccgcccaccgggcccgcgcgaacgagtccgccaccatcctcatgacggccaccccgcccggcaccagcgacgagttcccccactccaacggggagatcgaggacgtgcagaccgacatccccagcgagccgtggaacacgggccacgactggatcctggccgacaagcggcccaccgcctggttcctgcccagcatccgcgcggccaacgtcatggccgcctccctccggaaggcgggcaagagcgtggtggtcctgaaccgcaagaccttcgagcgcgagtaccccaccatcaagcagaagaagccggacttcatcctggccacggacatcgccgagatgggggccaacctctgcgtggagcgggtgctggactgccgcaccgccttcaagcccgtcctggtggacgaggggcggaaggtggcgatcaagggccccctccgcatctccgccagctccgccgcccagcggcgcggccggatcgggcgcaaccccaaccgggacggcgacagctactactactccgagccgaccagcgagaacaacgcccaccacgtctgctggctggaggcgtccatgctgctcgacaacatggaggtgcgcgggggcatggtggcgcccctgtacggcgtcgaggggaccaagacgcccgtgagccccggcgagatgcggctgcgcgacgaccagcggaaggtgttccgcgagctcgtccggaactgcgacctgccggtgtggctgtcctggcaggtcgccaaggccgggctcaagaccaacgaccgcaagtggtgcttcgagggccccgaggagcacgagatcctgaacgacagcggggagaccgtgaagtgccgggcccccggcggcgccaagaagccgctgcgcccccggtggtgcgacgagcgcgtgtccagcgaccagtccgccctcagcgagttcatcaagttcgccgaggggcgccgg

SEQ ID NO: 140 - RNA, 447 nt, synthetic construct
  misc_feature 1..447: note = derived and/or modified CDS sequence (opt1) from YFV 17D__NC_002031.1__NS4A-P2K
  source 1..447: mol_type = other RNA
ggcgccgccgaggtgctggtcgtgctcagcgagctgcccgacttcctggcgaagaagggcggggaggccatggacaccatctccgtgttcctccacagcgaggaggggtcccgcgcctaccggaacgccctgagcatgatgccggaggccatgaccatcgtcatgctgttcatcctcgcgggcctgctgacgtccgggatggtgatcttcttcatgagccccaagggcatctcccgcatgagcatggccatgggcaccatggccgggtgcggctacctcatgttcctcgggggcgtgaagcccacccacatctcctacgtcatgctgatcttcttcgtgctgatggtggtcgtgatccccgagccggggcagcagcggagcatccaggacaaccaggtggcctacctgatcatcggcatcctgaccctcgtctccgcggtggccgcc

SEQ ID NO: 141 - RNA, 750 nt, synthetic construct; identical to SEQ ID NO: 103
  misc_feature 1..750: note = derived and/or modified CDS sequence (opt1) from YFV 17D__NC_002031.1__NS4B
  source 1..750: mol_type = other RNA

SEQ ID NO: 142 - RNA, 2715 nt, synthetic construct
  misc_feature 1..2715: note = derived and/or modified CDS sequence (opt1) from YFV 17D__NC_002031.1__NS5
  source 1..2715: mol_type = other RNA
ggcagcgccaacgggaagaccctgggcgaggtgtggaagcgcgagctcaacctgctggacaagcggcagttcgagctctacaagcgcaccgacatcgtcgaggtggaccgggacacggcccgccggcacctggcggaggggaaggtggacaccggcgtcgccgtgtcccgcgggaccgccaagctgcggtggttccacgagcgcggctacgtgaagctcgagggccgggtcatcgacctggggtgcggccgcgggggctggtgctactacgccgccgcgcagaaggaggtgagcggggtgaagggcttcaccctgggccgggacgggcacgagaagcccatgaacgtccagtccctcggctggaacatcatcacgttcaaggacaagaccgacatccaccgcctggagccggtgaagtgcgacaccctgctctgcgacatcggggagagctccagctccagcgtgaccgagggcgagcggacggtccgcgtgctggacaccgtggagaagtggctggcctgcggcgtcgacaacttctgcgtgaaggtgctcgccccctacatgcccgacgtcctggagaagctggagctcctgcagcggcgcttcgggggcaccgtgatccggaaccccctgtcccgcaacagcacccacgagatgtactacgtgtccggggcccggagcaacgtcacgttcaccgtgaaccagacctcccgcctcctgatgcggcgcatgcgccggccgaccggcaaggtgacgctggaggcggacgtcatcctccccatcgggacccgcagcgtggagaccgacaagggccccctggacaaggaggccatcgaggagcgggtcgagcgcatcaagtccgagtacatgaccagctggttctacgacaacgacaacccctaccggacgtggcactactgcggctcctacgtgaccaagaccagcgggtccgccgccagcatggtgaacggcgtcatcaagatcctgacctacccgtgggaccgcatcgaggaggtgacgcggatggccatgaccgacaccacccccttcgggcagcagcgcgtgttcaaggagaaggtcgacacgcgggcgaaggacccgcccgccggcacccgcaagatcatgaaggtggtgaaccggtggctgttccgccacctcgcccgggagaagaacccgcgcctgtgcaccaaggaggagttcatcgccaaggtccggagccacgccgcgatcggggcctacctcgaggagcaggagcagtggaagaccgccaacgaggccgtgcaggaccccaagttctgggagctggtggacgaggagcgcaagctgcaccagcagggccggtgccgcacgtgcgtctacaacatgatgggcaagcgggagaagaagctctccgagttcgggaaggccaagggcagccgcgcgatctggtacatgtggctgggggcccgctacctggagttcgaggccctcggcttcctgaacgaggaccactgggcctcccgggagaacagcgggggcggcgtggaggggatcggcctgcagtacctcgggtacgtgatccgcgacctggccgcgatggacggcggcgggttctacgccgacgacaccgccggctgggacacccggatcaccgaggccgacctggacgacgagcaggagatcctcaactacatgagcccccaccacaagaagctggcgcaggccgtcatggagatgacgtacaagaacaaggtggtgaaggtcctgcgccccgcccccgggggcaaggcctacatggacgtgatctcccggcgcgaccagcgggggtccggccaggtggtcacctacgccctcaacaccatcaccaacctgaaggtgcagctgatccgcatggcggaggccgagatggtgatccaccaccagcacgtccaggactgcgacgagagcgtgctcacccggctggaggcctggctgacggagcacggctgcgaccgcctgaagcggatggccgtgtccggggacgactgcgtcgtgcgccccatcgacgaccggttcggcctcgccctgagccacctgaacgcgatgtccaaggtgcgcaaggacatcagcgagtggcagccctccaaggggtggaacgactgggagaacgtccccttctgcagccaccacttccacgagctccagctgaaggacggccggcgcatcgtggtgccgtgccgggagcaggacgagctgatcgggcgcggccgggtctcccccggcaacgggtggatgatcaaggagaccgcctgcctcagcaaggcctacgccaacatgtggtccctgatgtacttccacaagcgcgacatgcggctgctcagcctggccgtgtccagcgcggtgcccaccagctgggtcccccagggccgcaccacgtggtccatccacgggaagggcgagtggatgaccaccgaggacatgctggaggtgtggaaccgcgtgtggatcaccaacaacccgcacatgcaggacaagacgatggtcaagaagtggcgggacgtgccctacctcaccaagcgccaggacaagctgtgcgggagcctgatcggcatgaccaaccgggccacctgggcctcccacatccacctcgtgatccaccgcatccggacgctgatcggccaggagaagtacaccgactacctgaccgtcatggaccgctacagcgtggacgccgacctccagctgggggagctgatc

SEQ ID NO: 143 - RNA, 2334 nt, synthetic construct
  misc_feature 1..2334: note = derived and/or modified CDS sequence (opt1) from YFV 17D__NC_002031.1__C-prME
  source 1..2334: mol_type = other RNA
atgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtcaaggtgagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggcc

SEQ ID NO: 144 - RNA, 3390 nt, synthetic construct
  misc_feature 1..3390: note = derived and/or modified CDS sequence (opt1) from YFV 17D__NC_002031.1__C-prME-NS1
  source 1..3390: mol_type = other RNA
atgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtcaaggtgagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagtccgcccacgggagcccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtccccctcgaggtgaagcgggaggcctgcccgggcaccagcgtgatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtaccccatggagatccggccccgcaagacgcacgagtcccacctggtccggagctgggtgaccgcc

SEQ ID NO: 145 - RNA, 30 nt, synthetic construct
  misc_feature 1..30: note = derived and/or modified CDS sequence (opt1) from YFV 17D__NC_002031.1__X or 10aa (5'-terminus)
  source 1..30: mol_type = other RNA
atgcgcggcctgagctcccggaagcgccgg

SEQ ID NO: 146 - RNA, 60 nt, synthetic construct
  misc_feature 1..60: note = derived and/or modified CDS sequence (opt1) from YFV 17D__NC_002031.1__SS or ER anchor (v1)
  source 1..60: mol_type = other RNA
agccacgacgtgctgaccgtccagttcctcatcctgggcatgctgctcatgaccgggggc

SEQ ID NO: 147 - RNA, 54 nt, synthetic construct; identical to SEQ ID NO: 111
  misc_feature 1..54: note = derived and/or modified CDS sequence (opt1) from YFV 17D__NC_002031.1__SS or ER anchor (v2)
  source 1..54: mol_type = other RNA

SEQ ID NO: 148 - RNA, 72 nt, synthetic construct
  misc_feature 1..72: note = derived and/or modified CDS sequence (opt1) from YFV 17D__NC_002031.1__SS or ER anchor (v4)
  source 1..72: mol_type = other RNA
agccacgacgtgctgaccgtccagttcctcatcctgggcatgctgctcatgaccgggggcgtgacgctggtg

SEQ ID NO: 149 - RNA, 90 nt, synthetic construct
  misc_feature 1..90: note = derived and/or modified CDS sequence (opt1) from YFV 17D__NC_002031.1__X-SS or 10aa (5'-terminus)-SS (v1)
  source 1..90: mol_type = other RNA
atgcgcggcctgagctcccggaagcgccggagccacgacgtgctcaccgtccagttcctgatcctggggatgctcctgatgaccggcggg

SEQ ID NO: 150 - RNA, 102 nt, synthetic construct
  misc_feature 1..102: note = derived and/or modified CDS sequence (opt1) from YFV 17D__NC_002031.1__X-SS or 10aa (5'-terminus)-SS (v2)
  source 1..102: mol_type = other RNA
atgcgcggcctgagctcccggaagcgccggagccacgacgtgctcaccgtccagttcctgatcctggggatgctcctgatgaccggcggggtgacgctggtg

SEQ ID NO: 151 - RNA, 30 nt, synthetic construct; identical to SEQ ID NO: 118
  misc_feature 1..30: note = derived and/or modified CDS sequence (opt1) from YFV 17D__NC_002031.1__XX or 10aa (3'-terminus)
  source 1..30: mol_type = other RNA

SEQ ID NO: 152 - RNA, 2091 nt, synthetic construct
  misc_feature 1..2091: note = derived and/or modified CDS sequence (opt1) from YFV 17D__NC_002031.1__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccgccagtgggcccaggacctgaccctgccctggcagtccggcagcggcggggtctggcgggagatgcaccacctcgtggagttcgagcccccgcacgccgccacgatccgcgtgctggcgctgggcaaccaggaggggtccctcaagaccgccctgaccggcgccatgcgggtcaccaaggacacgaacgacaacaacctgtacaagctccacgggggccacgtgagctgccgcgtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccggatccccgtgatcgtcgccgacgacctgaccgccgccatcaacaagggcatcctggtgaccgtgaacccgatcgccagcacgaacgacgacgaggtcctcatcgaggtgaacccgcccttcggcgactcctacatcatcgtggggcgcggcgacagccggctgacctaccagtggcacaaggaggggtccagcatcggcaagctgttcacccagaccatgaagggggtcgagcgcctcgcggtgatgggcgacacggcctgggacttctccagcgccggcgggttcttcacctccgtgggcaaggggatccacaccgtcttcggcagcgccttccaggggctgttcggcggcctgaactggatcaccaaggtgatcatgggggccgtgctgatctgggtcggcatcaacacgcggaacatgaccatgtccatgagcatgatcctcgtgggggtgatcatgatgttcctgagcctgggcgtcggggcggaccagggctgcgccatcaacttcggcaag

SEQ ID NO: 153 - RNA, 1581 nt, synthetic construct
  misc_feature 1..1581: note = derived and/or modified CDS sequence (opt1) from YFV 17D__NC_002031.1__X-SS-E
  source 1..1581: mol_type = other RNA
atgcgcggcctgagctcccggaagcgccggagccacgacgtgctcaccgtccagttcctgatcctggggatgctcctgatgaccggcggggtgacgctggtggcccactgcatcggcatcaccgaccgcgacttcatcgagggggtccacggcggcacctgggtgtccgccaccctcgagcaggacaagtgcgtgacggtcatggcgcccgacaagcccagcctggacatctccctggagaccgtggccatcgaccggcccgccgaggtgcgcaaggtctgctacaacgccgtgctcacccacgtgaagatcaacgacaagtgccccagcaccggggaggcccacctggcggaggagaacgagggcgacaacgcctgcaagcggacgtactccgaccgcgggtggggcaacgggtgcggcctgttcggcaaggggagcatcgtcgcctgcgccaagttcacgtgcgcgaagtccatgagcctcttcgaggtggaccagaccaagatccagtacgtgatccgggcccagctgcacgtcggcgccaagcaggagaactggaacaccgacatcaagaccctgaagttcgacgccctctccgggagccaggaggtggagttcatcggctacggcaaggccaccctggagtgccaggtgcagaccgcggtcgacttcgggaactcctacatcgccgagatggagaccgagagctggatcgtggaccgccagtgggcccaggacctgacgctcccctggcagtccggcagcgggggcgtgtggcgggagatgcaccacctggtcgagttcgagccgccccacgccgccaccatccgcgtgctggcgctcgggaaccaggagggctccctgaagaccgccctgaccggcgccatgcgggtgacgaaggacaccaacgacaacaacctctacaagctgcacgggggccacgtcagctgccgcgtgaagctgtccgccctcaccctgaaggggaccagctacaagatctgcacggacaagatgttcttcgtcaagaaccccaccgacaccggccacgggaccgtggtgatgcaggtcaaggtgagcaagggcgccccctgccggatcccggtgatcgtcgcggacgacctgacggccgccatcaacaagggcatcctcgtgaccgtgaaccccatcgcctccaccaacgacgacgaggtcctgatcgaggtgaacccgcccttcggggacagctacatcatcgtgggccgcggggactcccggctgacctaccagtggcacaaggagggcagctccatcgggaagctgttcacgcagaccatgaagggcgtcgagcgcctcgccgtgatgggcgacaccgcgtgggacttcagctccgccgggggcttcttcaccagcgtggggaagggcatccacacggtcttcggctccgccttccaggggctgttcggcgggctcaactggatcaccaaggtgatcatgggcgccgtgctgatctgggtcgggatcaacacccggaacatgaccatgagcatgtccatgatcctggtgggcgtgatcatgatgttcctcagcctgggcgtcggggcg

SEQ ID NO: 154 - RNA, 1611 nt, synthetic construct
  misc_feature 1..1611: note = derived and/or modified CDS sequence (opt1) from YFV 17D__NC_002031.1__X-SS-E-XX
  source 1..1611: mol_type = other RNA
atgcgcggcctgagctcccggaagcgccggagccacgacgtgctcaccgtccagttcctgatcctggggatgctcctgatgaccggcggggtgacgctggtggcccactgcatcggcatcaccgaccgcgacttcatcgagggggtccacggcggcacctgggtgtccgccaccctcgagcaggacaagtgcgtgacggtcatggcgcccgacaagcccagcctggacatctccctggagaccgtggccatcgaccggcccgccgaggtgcgcaaggtctgctacaacgccgtgctcacccacgtgaagatcaacgacaagtgccccagcaccggggaggcccacctggcggaggagaacgagggcgacaacgcctgcaagcggacgtactccgaccgcgggtggggcaacgggtgcggcctgttcggcaaggggagcatcgtcgcctgcgccaagttcacgtgcgcgaagtccatgagcctcttcgaggtggaccagaccaagatccagtacgtgatccgggcccagctgcacgtcggcgccaagcaggagaactggaacaccgacatcaagaccctgaagttcgacgccctctccgggagccaggaggtggagttcatcggctacggcaaggccaccctggagtgccaggtgcagaccgcggtcgacttcgggaactcctacatcgccgagatggagaccgagagctggatcgtggaccgccagtgggcccaggacctgacgctcccctggcagtccggcagcgggggcgtgtggcgggagatgcaccacctggtcgagttcgagccgccccacgccgccaccatccgcgtgctggcgctcgggaaccaggagggctccctgaagaccgccctgaccggcgccatgcgggtgacgaaggacaccaacgacaacaacctctacaagctgcacgggggccacgtcagctgccgcgtgaagctgtccgccctcaccctgaaggggaccagctacaagatctgcacggacaagatgttcttcgtcaagaaccccaccgacaccggccacgggaccgtggtgatgcaggtcaaggtgagcaagggcgccccctgccggatcccggtgatcgtcgcggacgacctgacggccgccatcaacaagggcatcctcgtgaccgtgaaccccatcgcctccaccaacgacgacgaggtcctgatcgaggtgaacccgcccttcggggacagctacatcatcgtgggccgcggggactcccggctgacctaccagtggcacaaggagggcagctccatcgggaagctgttcacgcagaccatgaagggcgtcgagcgcctcgccgtgatgggcgacaccgcgtgggacttcagctccgccgggggcttcttcaccagcgtggggaagggcatccacacggtcttcggctccgccttccaggggctgttcggcgggctcaactggatcaccaaggtgatcatgggcgccgtgctgatctgggtcgggatcaacacccggaacatgaccatgagcatgtccatgatcctggtgggcgtgatcatgatgttcctcagcctgggcgtcggggcggaccagggctgcgccatcaacttcgggaag

SEQ ID NO: 155 - RNA, 2025 nt, synthetic construct
  misc_feature 1..2025: note = derived and/or modified CDS sequence (opt1) from YFV 17D__NC_002031.1__SS-prME
  source 1..2025: mol_type = other RNA
gacgtgctgaccgtccagttcctcatcctgggcatgctgctcatgaccgggggcgtgacgctggtgcgcaagaaccggtggctgctcctgaacgtcaccagcgaggacctggggaagaccttctccgtgggcaccgggaactgcacgaccaacatcctcgaggccaagtactggtgccccgacagcatggagtacaactgccccaacctgagcccccgcgaggagcccgacgacatcgactgctggtgctacggcgtggagaacgtccgggtggcctacggcaagtgcgactccgcggggcgctcccggcgcagccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggtccaacatgacccagcgcgtggtcatcgcgctgctggtgctcgccgtgggccccgcctacagcgcccactgcatcggcatcacggaccgggacttcatcgagggggtccacggcgggacctgggtgtccgcgaccctggagcaggacaagtgcgtgaccgtcatggcccccgacaagcccagcctggacatctccctcgagacggtggccatcgaccgcccggccgaggtgcggaaggtctgctacaacgccgtgctgacccacgtgaagatcaacgacaagtgccccagcaccggcgaggcgcacctggccgaggagaacgagggcgacaacgcctgcaagcgcacctactccgaccgggggtggggcaacgggtgcggcctcttcgggaagggcagcatcgtcgcctgcgccaagttcacgtgcgcgaagtccatgagcctgttcgaggtggaccagaccaagatccagtacgtcatccgcgcccagctgcacgtgggcgccaagcaggagaactggaacaccgacatcaagaccctcaagttcgacgccctgtccgggagccaggaggtggagttcatcggctacgggaaggccacgctggagtgccaggtccagaccgcggtggacttcggcaactcctacatcgccgagatggagaccgagagctggatcgtggaccggcagtgggcccaggacctcaccctgccctggcagagcgggtccggcggcgtctggcgcgagatgcaccacctggtggagttcgagcccccgcacgccgccacgatccgcgtgctcgcgctggggaaccaggagggcagcctgaagaccgccctcaccggggccatgcgggtcaccaaggacacgaacgacaacaacctgtacaagctgcacggcgggcacgtgtcctgccgcgtgaagctcagcgccctgaccctgaagggcacctcctacaagatctgcaccgacaagatgttcttcgtcaagaaccccacggacaccggccacgggaccgtggtgatgcaggtcaaggtgagcaagggcgcgccctgccggatccccgtgatcgtcgccgacgacctcaccgccgccatcaacaaggggatcctggtgaccgtgaacccgatcgcctccacgaacgacgacgaggtcctgatcgaggtgaacccgcccttcggcgacagctacatcatcgtgggccgcggggactcccggctcacctaccagtggcacaaggagggcagctccatcgggaagctgttcacccagaccatgaagggcgtcgagcgcctggcggtgatgggggacacggcctgggacttcagctccgccggcggcttcttcaccagcgtggggaagggcatccacaccgtcttcgggtccgccttccagggcctcttcgggggcctgaactggatcaccaaggtgatcatgggcgccgtgctgatctgggtcgggatcaacacgcggaacatgaccatgagcatgtccatgatcctggtgggcgtgatcatgatgttcctcagcctgggggtcggcgcg

SEQ ID NO: 156 - RNA, 3081 nt, synthetic construct
  misc_feature 1..3081: note = derived and/or modified CDS sequence (opt1) from YFV 17D__NC_002031.1__SS-prME-NS1
  source 1..3081: mol_type = other RNA
gacgtgctgaccgtccagttcctcatcctgggcatgctgctcatgaccgggggcgtgacgctggtgcgcaagaaccggtggctgctcctgaacgtcaccagcgaggacctggggaagaccttctccgtgggcaccgggaactgcacgaccaacatcctcgaggccaagtactggtgccccgacagcatggagtacaactgcccgaacctgagcccccgcgaggagcccgacgacatcgactgctggtgctacggcgtggagaacgtccgggtggcctacggcaagtgcgactccgcggggcgctcccggcgcagccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggtccaacatgacccagcgcgtggtcatcgcgctgctggtgctcgccgtgggccccgcctacagcgcccactgcatcggcatcacggaccgggacttcatcgagggggtccacggcgggacctgggtgtccgcgaccctggagcaggacaagtgcgtgaccgtcatggcccccgacaagcccagcctggacatctccctcgagacggtggccatcgaccgcccggccgaggtgcggaaggtctgctacaacgccgtgctgacccacgtgaagatcaacgacaagtgccccagcaccggcgaggcgcacctggccgaggagaacgagggcgacaacgcctgcaagcgcacctactccgaccgggggtggggcaacgggtgcggcctcttcgggaagggcagcatcgtcgcctgcgccaagttcacgtgcgcgaagtccatgagcctgttcgaggtggaccagaccaagatccagtacgtcatccgcgcccagctgcacgtgggcgccaagcaggagaactggaacaccgacatcaagaccctcaagttcgacgccctgtccgggagccaggaggtggagttcatcggctacgggaaggccacgctggagtgccaggtccagaccgcggtggacttcggcaactcctacatcgccgagatggagaccgagagctggatcgtggaccggcagtgggcccaggacctcaccctgccctggcagagcgggtccggcggcgtctggcgcgagatgcaccacctggtggagttcgagcccccgcacgccgccacgatccgcgtgctcgcgctggggaaccaggagggcagcctgaagaccgccctcaccggggccatgcgggtcaccaaggacacgaacgacaacaacctgtacaagctgcacggcgggcacgtgtcctgccgcgtgaagctcagcgccctgaccctgaagggcacctcctacaagatctgcaccgacaagatgttcttcgtcaagaaccccacggacaccggccacgggaccgtggtgatgcaggtcaaggtgagcaagggcgcgccctgccggatccccgtgatcgtcgccgacgacctcaccgccgccatcaacaaggggatcctggtgaccgtgaacccgatcgcctccacgaacgacgacgaggtcctgatcgaggtgaacccgcccttcggcgacagctacatcatcgtgggccgcggggactcccggctcacctaccagtggcacaaggagggcagctccatcgggaagctgttcacccagaccatgaagggcgtcgagcgcctggcggtgatgggggacacggcctgggacttcagctccgccggcggcttcttcaccagcgtggggaagggcatccacaccgtcttcgggtccgccttccagggcctcttcgggggcctgaactggatcaccaaggtgatcatgggcgccgtgctgatctgggtcgggatcaacacgcggaacatgaccatgagcatgtccatgatcctggtgggcgtgatcatgatgttcctcagcctgggggtcggcgcggaccaggggtgcgccatcaacttcggcaagcgcgagctgaagtgcggcgacgggatcttcatcttccgggactccgacgactggctcaacaagtacagctactaccccgaggaccccgtgaagctggccagcatcgtgaaggcctccttcgaggagggcaagtgcgggctgaacagcgtcgactccctcgagcacgagatgtggcgcagccgggccgacgagatcaacgcgatcttcgaggagaacgaggtggacatctccgtggtcgtgcaggaccccaagaacgtgtaccagcgcggcacccaccccttcagccggatccgcgacgggctgcagtacggctggaagacctggggcaagaacctggtcttctcccccgggcggaagaacggcagcttcatcatcgacgggaagtcccgcaaggagtgcccgttcagcaaccgggtgtggaactccttccagatcgaggagttcggcacgggcgtgttcaccacccgcgtctacatggacgccgtgttcgagtacaccatcgactgcgacgggagcatcctcggcgccgccgtgaacgggaagaagtccgcgcacggcagccccacgttctggatggggtcccacgaggtcaacggcacctggatgatccacaccctggaggccctggactacaaggagtgcgagtggcccctcacccacacgatcggcaccagcgtggaggagtccgagatgttcatgccccggagcatcgggggcccggtgagctcccacaaccacatccccgggtacaaggtccagaccaacggcccctggatgcaggtcccgctggaggtgaagcgcgaggcctgccccgggaccagcgtgatcatcgacggcaactgcgacggccgcgggaagtccacgcggagcaccaccgactccggcaaggtgatccccgagtggtgctgccgcagctgcaccatgcccccggtctccttccacgggagcgacggctgctggtaccccatggagatccggccccgcaagacgcacgagtcccacctggtgcggagctgggtgaccgcc

SEQ ID NO: 157 - RNA, 273 nt, synthetic construct; identical to SEQ ID NO: 125
  misc_feature 1..273: note = derived and/or modified CDS sequence (opt1) from YFV 17D__NC_002031.1__C (without X-SS)
  source 1..273: mol_type = other RNA

SEQ ID NO: 158 - RNA, 1026 nt, synthetic construct
  misc_feature 1..1026: note = derived and/or modified CDS sequence (opt1) from YFV 17D__NC_002031.1__NS1 (without XX)
  source 1..1026: mol_type = other RNA
cgcgagctgaagtgcggcgacgggatcttcatcttccgggacagcgacgactggctcaacaagtactcctactaccccgaggacccggtgaagctggccagcatcgtcaaggcctccttcgaggagggcaagtgcgggctgaacagcgtggactccctcgagcacgagatgtggcgcagccgggcggacgagatcaacgccatcttcgaggagaacgaggtggacatctccgtcgtggtgcaggaccccaagaacgtctaccagcgcggcacccaccccttcagccggatccgcgacgggctgcagtacggctggaagacctggggcaagaacctggtgttctcccccgggcggaagaacggcagcttcatcatcgacgggaagtcccgcaaggagtgcccgttcagcaaccgggtgtggaactccttccagatcgaggagttcggcacgggggtcttcaccacccgcgtgtacatggacgccgtgttcgagtacaccatcgactgcgacggcagcatcctcggcgccgccgtcaacgggaagaagtccgcgcacggcagccccacgttctggatggggtcccacgaggtgaacggcacctggatgatccacaccctggaggccctggactacaaggagtgcgagtggcccctcacccacacgatcggcaccagcgtggaggagtccgagatgttcatgccccggagcatcgggggcccggtcagctcccacaaccacatccccgggtacaaggtgcagaccaacggcccctggatgcaggtccccctggaggtgaagcgcgaggcctgcccggggaccagcgtgatcatcgacggcaactgcgacggccgggggaagtccacgcgcagcaccaccgactccggcaaggtgatccccgagtggtgctgccggagctgcaccatgccgcccgtctccttccacgggagcgacggctgctggtaccccatggagatccgcccccggaagacgcacgagtcccacctggtgcgcagctgggtgaccgcc

SEQ ID NO: 159 - RNA, 10233 nt, synthetic construct
  misc_feature 1..10233: note = derived and/or modified CDS sequence (opt2) from YFV 17D__NC_002031.1__polyprotein
  source 1..10233: mol_type = other RNA
atgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgccggcgagatccacgccgtccccttcggcctcgtctccatgatgatcgccatggaggtcgtcctccgcaagcgccagggccccaagcagatgctcgtcggcggcgtcgtcctcctcggcgccatgctcgtcggccaggtcaccctcctcgacctcctcaagctcaccgtcgccgtcggcctccacttccacgagatgaacaacggcggcgacgccatgtacatggccctcatcgccgccttctccatccgccccggcctcctcatcggcttcggcctccgcaccctctggtccccccgcgagcgcctcgtcctcaccctcggcgccgccatggtcgagatcgccctcggcggcgtcatgggcggcctctggaagtacctcaacgccgtctccctctgcatcctcaccatcaacgccgtcgcctcccgcaaggcctccaacaccatcctccccctcatggccctcctcacccccgtcaccatggccgaggtccgcctcgccgccatgttcttctgcgccgtcgtcatcatcggcgtcctccaccagaacttcaaggacacctccatgcagaagaccatccccctcgtcgccctcaccctcacctcctacctcggcctcacccagcccttcctcggcctctgcgccttcctcgccacccgcatcttcggccgccgctccatccccgtcaacgaggccctcgccgccgccggcctcgtcggcgtcctcgccggcctcgccttccaggagatggagaacttcctcggccccatcgccgtcggcggcctcctcatgatgctcgtctccgtcgccggccgcgtcgacggcctcgagctcaagaagctcggcgaggtctcctgggaggaggaggccgagatctccggctcctccgcccgctacgacgtcgccctctccgagcagggcgagttcaagctcctctccgaggagaaggtcccctgggaccaggtcgtcatgacctccctcgccctcgtcggcgccgccctccaccccttcgccctcctcctcgtcctcgccggctggctcttccacgtccgcggcgcccgccgctccggcgacgtcctctgggacatccccacccccaagatcatcgaggagtgcgagcacctcgaggacggcatctacggcatcttccagtccaccttcctcggcgcctcccagcgcggcgtcggcgtcgcccagggcggcgtcttccacaccatgtggcacgtcacccgcggcgccttcctcgtccgcaacggcaagaagctcatcccctcctgggcctccgtcaaggaggacctcgtcgcctacggcggctcctggaagctcgagggccgctgggacggcgaggaggaggtccagctcatcgccgccgtccccggcaagaacgtcgtcaacgtccagaccaagccctccctcttcaaggtccgcaacggcggcgagatcggcgccgtcgccctcgactacccctccggcacctccggctcccccatcgtcaaccgcaacggcgaggtcatcggcctctacggcaacggcatcctcgtcggcgacaactccttcgtctccgccatctcccagaccgaggtcaaggaggagggcaaggaggagctccaggagatccccaccatgctcaagaagggcatgaccaccgtcctcgacttccaccccggcgccggcaagacccgccgcttcctcccccagatcctcgccgagtgcgcccgccgccgcctccgcaccctcgtcctcgcccccacccgcgtcgtcctctccgagatgaaggaggccttccacggcctcgacgtcaagttccacacccaggccttctccgcccacggctccggccgcgaggtcatcgacgccatgtgccacgccaccctcacctaccgcatgctcgagcccacccgcgtcgtcaactgggaggtcatcatcatggacgaggcccacttcctcgaccccgcctccatcgccgcccgcggctgggccgcccaccgcgcccgcgccaacgagtccgccaccatcctcatgaccgccaccccccccggcacctccgacgagttcccccactccaacggcgagatcgaggacgtccagaccgacatcccctccgagccctggaacaccggccacgactggatcctcgccgacaagcgccccaccgcctggttcctcccctccatccgcgccgccaacgtcatggccgcctccctccgcaaggccggcaagtccgtcgtcgtcctcaaccgcaagaccttcgagcgcgagtaccccaccatcaagcagaagaagcccgacttcatcctcgccaccgacatcgccgagatgggcgccaacctctgcgtcgagcgcgtcctcgactgccgcaccgccttcaagcccgtcctcgtcgacgagggccgcaaggtcgccatcaagggccccctccgcatctccgcctcctccgccgcccagcgccgcggccgcatcggccgcaaccccaaccgcgacggcgactcctactactactccgagcccacctccgagaacaacgcccaccacgtctgctggctcgaggcctccatgctcctcgacaacatggaggtccgcggcggcatggtcgcccccctctacggcgtcgagggcaccaagacccccgtctcccccggcgagatgcgcctccgcgacgaccagcgcaaggtcttccgcgagctcgtccgcaactgcgacctccccgtctggctctcctggcaggtcgccaaggccggcctcaagaccaacgaccgcaagtggtgcttcgagggccccgaggagcacgagatcctcaacgactccggcgagaccgtcaagtgccgcgcccccggcggcgccaagaagcccctccgcccccgctggtgcgacgagcgcgtctcctccgaccagtccgccctctccgagttcatcaagttcgccgagggccgccgcggcgccgccgaggtcctcgtcgtcctctccgagctccccgacttcctcgccaagaagggcggcgaggccatggacaccatctccgtcttcctccactccgaggagggctcccgcgcctaccgcaacgccctctccatgatgcccgaggccatgaccatcgtcatgctcttcatcctcgccggcctcctcacctccggcatggtcatcttcttcatgtcccccaagggcatctcccgcatgtccatggccatgggcaccatggccggctgcggctacctcatgttcctcggcggcgtcaagcccacccacatctcctacgtcatgctcatcttcttcgtcctcatggtcgtcgtcatccccgagcccggccagcagcgctccatccaggacaaccaggtcgcctacctcatcatcggcatcctcaccctcgtctccgccgtcgccgccaacgagctcggcatgctcgagaagaccaaggaggacctcttcggcaagaagaacctcatcccctcctccgcctccccctggtcctggcccgacctcgacctcaagcccggcgccgcctggaccgtctacgtcggcatcgtcaccatgctctcccccatgctccaccactggatcaaggtcgagtacggcaacctctccctctccggcatcgcccagtccgcctccgtcctctccttcatggacaagggcatccccttcatgaagatgaacatctccgtcatcatgctcctcgtctccggctggaactccatcaccgtcatgcccctcctctgcggcatcggctgcgccatgctccactggtccctcatcctccccggcatcaaggcccagcagtccaagctcgcccagcgccgcgtcttccacggcgtcgccgagaaccccgtcgtcgacggcaaccccaccgtcgacatcgaggaggcccccgagatgcccgccctctacgagaagaagctcgccctctacctcctcctcgccctctccctcgcctccgtcgccatgtgccgcacccccttctccctcgccgagggcatcgtcctcgcctccgccgccctcggccccctcatcgagggcaacacctccctcctctggaacggccccatggccgtctccatgaccggcgtcatgcgcggcaaccactacgccttcgtcggcgtcatgtacaacctctggaagatgaagaccggccgccgcggctccgccaacggcaagaccctcggcgaggtctggaagcgcgagctcaacctcctcgacaagcgccagttcgagctctacaagcgcaccgacatcgtcgaggtcgaccgcgacaccgcccgccgccacctcgccgagggcaaggtcgacaccggcgtcgccgtctcccgcggcaccgccaagctccgctggttccacgagcgcggctacgtcaagctcgagggccgcgtcatcgacctcggctgcggccgcggcggctggtgctactacgccgccgcccagaaggaggtctccggcgtcaagggcttcaccctcggccgcgacggccacgagaagcccatgaacgtccagtccctcggctggaacatcatcaccttcaaggacaagaccgacatccaccgcctcgagcccgtcaagtgcgacaccctcctctgcgacatcggcgagtcctcctcctcctccgtcaccgagggcgagcgcaccgtccgcgtcctcgacaccgtcgagaagtggctcgcctgcggcgtcgacaacttctgcgtcaaggtcctcgccccctacatgcccgacgtcctcgagaagctcgagctcctccagcgccgcttcggcggcaccgtcatccgcaaccccctctcccgcaactccacccacgagatgtactacgtctccggcgcccgctccaacgtcaccttcaccgtcaaccagacctcccgcctcctcatgcgccgcatgcgccgccccaccggcaaggtcaccctcgaggccgacgtcatcctccccatcggcacccgctccgtcgagaccgacaagggccccctcgacaaggaggccatcgaggagcgcgtcgagcgcatcaagtccgagtacatgacctcctggttctacgacaacgacaacccctaccgcacctggcactactgcggctcctacgtcaccaagacctccggctccgccgcctccatggtcaacggcgtcatcaagatcctcacctacccctgggaccgcatcgaggaggtcacccgcatggccatgaccgacaccacccccttcggccagcagcgcgtcttcaaggagaaggtcgacacccgcgccaaggacccccccgccggcacccgcaagatcatgaaggtcgtcaaccgctggctcttccgccacctcgcccgcgagaagaacccccgcctctgcaccaaggaggagttcatcgccaaggtccgctcccacgccgccatcggcgcctacctcgaggagcaggagcagtggaagaccgccaacgaggccgtccaggaccccaagttctgggagctcgtcgacgaggagcgcaagctccaccagcagggccgctgccgcacctgcgtctacaacatgatgggcaagcgcgagaagaagctctccgagttcggcaaggccaagggctcccgcgccatctggtacatgtggctcggcgcccgctacctcgagttcgaggccctcggcttcctcaacgaggaccactgggcctcccgcgagaactccggcggcggcgtcgagggcatcggcctccagtacctcggctacgtcatccgcgacctcgccgccatggacggcggcggcttctacgccgacgacaccgccggctgggacacccgcatcaccgaggccgacctcgacgacgagcaggagatcctcaactacatgtccccccaccacaagaagctcgcccaggccgtcatggagatgacctacaagaacaaggtcgtcaaggtcctccgccccgcccccggcggcaaggcctacatggacgtcatctcccgccgcgaccagcgcggctccggccaggtcgtcacctacgccctcaacaccatcaccaacctcaaggtccagctcatccgcatggccgaggccgagatggtcatccaccaccagcacgtccaggactgcgacgagtccgtcctcacccgcctcgaggcctggctcaccgagcacggctgcgaccgcctcaagcgcatggccgtctccggcgacgactgcgtcgtccgccccatcgacgaccgcttcggcctcgccctctcccacctcaacgccatgtccaaggtccgcaaggacatctccgagtggcagccctccaagggctggaacgactgggagaacgtccccttctgctcccaccacttccacgagctccagctcaaggacggccgccgcatcgtcgtcccctgccgcgagcaggacgagctcatcggccgcggccgcgtctcccccggcaacggctggatgatcaaggagaccgcctgcctctccaaggcctacgccaacatgtggtccctcatgtacttccacaagcgcgacatgcgcctcctctccctcgccgtctcctccgccgtccccacctcctgggtcccccagggccgcaccacctggtccatccacggcaagggcgagtggatgaccaccgaggacatgctcgaggtctggaaccgcgtctggatcaccaacaacccccacatgcaggacaagaccatggtcaagaagtggcgcgacgtcccctacctcaccaagcgccaggacaagctctgcggctccctcatcggcatgaccaaccgcgccacctgggcctcccacatccacctcgtcatccaccgcatccgcaccctcatcggccaggagaagtacaccgactacctcaccgtcatggaccgctactccgtcgacgccgacctccagctcggcgagctcatc

SEQ ID NO: 160 - RNA, 303 nt, synthetic construct
  misc_feature 1..303: note = derived and/or modified CDS sequence (opt2) from YFV 17D__NC_002031.1__C
  source 1..303: mol_type = other RNA
atgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgc

SEQ ID NO: 161 - RNA, 363 nt, synthetic construct
  misc_feature 1..363: note = derived and/or modified CDS sequence (opt2) from YFV 17D__NC_002031.1__C-ER anchor
  source 1..363: mol_type = other RNA
atgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggc

SEQ ID NO: 162 - RNA, 267 nt, synthetic construct
  misc_feature 1..267: note = derived and/or modified CDS sequence (opt2) from YFV 17D__NC_002031.1__pr
  source 1..267: mol_type = other RNA
gtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgc

SEQ ID NO: 163 - RNA, 225 nt, synthetic construct
  misc_feature 1..225: note = derived and/or modified CDS sequence (opt2) from YFV 17D__NC_002031.1__M
  source 1..225: mol_type = other RNA
gccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactcc

SEQ ID NO: 164 - RNA, 492 nt, synthetic construct
  misc_feature 1..492: note = derived and/or modified CDS sequence (opt2) from YFV 17D__NC_002031.1__prM
  source 1..492: mol_type = other RNA
gtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactcc

SEQ ID NO: 165 - RNA, 1479 nt, synthetic construct
  misc_feature 1..1479: note = derived and/or modified CDS sequence (opt2) from YFV 17D__NC_002031.1__E
  source 1..1479: mol_type = other RNA
gcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 166 - RNA, 1971 nt, synthetic construct
  misc_feature 1..1971: note = derived and/or modified CDS sequence (opt2) from YFV 17D__NC_002031.1__prME
  source 1..1971: mol_type = other RNA
gtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 167 - RNA, 2031 nt, synthetic construct
  misc_feature 1..2031: note = derived and/or modified CDS sequence (opt2) from YFV 17D__NC_002031.1__ER anchor-prME
  source 1..2031: mol_type = other RNA
tcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 168 - RNA, 1056 nt, synthetic construct
  misc_feature 1..1056: note = derived and/or modified CDS sequence (opt2) from YFV 17D__NC_002031.1__NS1
  source 1..1056: mol_type = other RNA
gaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcc

SEQ ID NO: 169 - RNA, 672 nt, synthetic construct
  misc_feature 1..672: note = derived and/or modified CDS sequence (opt2) from YFV 17D__NC_002031.1__NS2A
  source 1..672: mol_type = other RNA
ggcgagatccacgccgtccccttcggcctcgtctccatgatgatcgccatggaggtcgtcctccgcaagcgccagggccccaagcagatgctcgtcggcggcgtcgtcctcctcggcgccatgctcgtcggccaggtcaccctcctcgacctcctcaagctcaccgtcgccgtcggcctccacttccacgagatgaacaacggcggcgacgccatgtacatggccctcatcgccgccttctccatccgccccggcctcctcatcggcttcggcctccgcaccctctggtccccccgcgagcgcctcgtcctcaccctcggcgccgccatggtcgagatcgccctcggcggcgtcatgggcggcctctggaagtacctcaacgccgtctccctctgcatcctcaccatcaacgccgtcgcctcccgcaaggcctccaacaccatcctccccctcatggccctcctcacccccgtcaccatggccgaggtccgcctcgccgccatgttcttctgcgccgtcgtcatcatcggcgtcctccaccagaacttcaaggacacctccatgcagaagaccatccccctcgtcgccctcaccctcacctcctacctcggcctcacccagcccttcctcggcctctgcgccttcctcgccacccgcatcttcggccgccgc

SEQ ID NO: 170 - RNA, 390 nt, synthetic construct
  misc_feature 1..390: note = derived and/or modified CDS sequence (opt2) from YFV 17D__NC_002031.1__NS2B
  source 1..390: mol_type = other RNA
tccatccccgtcaacgaggccctcgccgccgccggcctcgtcggcgtcctcgccggcctcgccttccaggagatggagaacttcctcggccccatcgccgtcggcggcctcctcatgatgctcgtctccgtcgccggccgcgtcgacggcctcgagctcaagaagctcggcgaggtctcctgggaggaggaggccgagatctccggctcctccgcccgctacgacgtcgccctctccgagcagggcgagttcaagctcctctccgaggagaaggtcccctgggaccaggtcgtcatgacctccctcgccctcgtcggcgccgccctccaccccttcgccctcctcctcgtcctcgccggctggctcttccacgtccgcggcgcccgccgc

SEQ ID NO: 171 - RNA, 1869 nt, synthetic construct
  misc_feature 1..1869: note = derived and/or modified CDS sequence (opt2) from YFV 17D__NC_002031.1__NS3
  source 1..1869: mol_type = other RNA
tccggcgacgtcctctgggacatccccacccccaagatcatcgaggagtgcgagcacctcgaggacggcatctacggcatcttccagtccaccttcctcggcgcctcccagcgcggcgtcggcgtcgcccagggcggcgtcttccacaccatgtggcacgtcacccgcggcgccttcctcgtccgcaacggcaagaagctcatcccctcctgggcctccgtcaaggaggacctcgtcgcctacggcggctcctggaagctcgagggccgctgggacggcgaggaggaggtccagctcatcgccgccgtccccggcaagaacgtcgtcaacgtccagaccaagccctccctcttcaaggtccgcaacggcggcgagatcggcgccgtcgccctcgactacccctccggcacctccggctcccccatcgtcaaccgcaacggcgaggtcatcggcctctacggcaacggcatcctcgtcggcgacaactccttcgtctccgccatctcccagaccgaggtcaaggaggagggcaaggaggagctccaggagatccccaccatgctcaagaagggcatgaccaccgtcctcgacttccaccccggcgccggcaagacccgccgcttcctcccccagatcctcgccgagtgcgcccgccgccgcctccgcaccctcgtcctcgcccccacccgcgtcgtcctctccgagatgaaggaggccttccacggcctcgacgtcaagttccacacccaggccttctccgcccacggctccggccgcgaggtcatcgacgccatgtgccacgccaccctcacctaccgcatgctcgagcccacccgcgtcgtcaactgggaggtcatcatcatggacgaggcccacttcctcgaccccgcctccatcgccgcccgcggctgggccgcccaccgcgcccgcgccaacgagtccgccaccatcctcatgaccgccaccccccccggcacctccgacgagttcccccactccaacggcgagatcgaggacgtccagaccgacatcccctccgagccctggaacaccggccacgactggatcctcgccgacaagcgccccaccgcctggttcctcccctccatccgcgccgccaacgtcatggccgcctccctccgcaaggccggcaagtccgtcgtcgtcctcaaccgcaagaccttcgagcgcgagtaccccaccatcaagcagaagaagcccgacttcatcctcgccaccgacatcgccgagatgggcgccaacctctgcgtcgagcgcgtcctcgactgccgcaccgccttcaagcccgtcctcgtcgacgagggccgcaaggtcgccatcaagggccccctccgcatctccgcctcctccgccgcccagcgccgcggccgcatcggccgcaaccccaaccgcgacggcgactcctactactactccgagcccacctccgagaacaacgcccaccacgtctgctggctcgaggcctccatgctcctcgacaacatggaggtccgcggcggcatggtcgcccccctctacggcgtcgagggcaccaagacccccgtctcccccggcgagatgcgcctccgcgacgaccagcgcaaggtcttccgcgagctcgtccgcaactgcgacctccccgtctggctctcctggcaggtcgccaaggccggcctcaagaccaacgaccgcaagtggtgcttcgagggccccgaggagcacgagatcctcaacgactccggcgagaccgtcaagtgccgcgcccccggcggcgccaagaagcccctccgcccccgctggtgcgacgagcgcgtctcctccgaccagtccgccctctccgagttcatcaagttcgccgagggccgccgc

SEQ ID NO: 172 - RNA, 447 nt, synthetic construct
  misc_feature 1..447: note = derived and/or modified CDS sequence (opt2) from YFV 17D__NC_002031.1__NS4A-P2K
  source 1..447: mol_type = other RNA
ggcgccgccgaggtcctcgtcgtcctctccgagctccccgacttcctcgccaagaagggcggcgaggccatggacaccatctccgtcttcctccactccgaggagggctcccgcgcctaccgcaacgccctctccatgatgcccgaggccatgaccatcgtcatgctcttcatcctcgccggcctcctcacctccggcatggtcatcttcttcatgtcccccaagggcatctcccgcatgtccatggccatgggcaccatggccggctgcggctacctcatgttcctcggcggcgtcaagcccacccacatctcctacgtcatgctcatcttcttcgtcctcatggtcgtcgtcatccccgagcccggccagcagcgctccatccaggacaaccaggtcgcctacctcatcatcggcatcctcaccctcgtctccgccgtcgccgcc

SEQ ID NO: 173 - RNA, 750 nt, synthetic construct
  misc_feature 1..750: note = derived and/or modified CDS sequence (opt2) from YFV 17D__NC_002031.1__NS4B
  source 1..750: mol_type = other RNA
aacgagctcggcatgctcgagaagaccaaggaggacctcttcggcaagaagaacctcatcccctcctccgcctccccctggtcctggcccgacctcgacctcaagcccggcgccgcctggaccgtctacgtcggcatcgtcaccatgctctcccccatgctccaccactggatcaaggtcgagtacggcaacctctccctctccggcatcgcccagtccgcctccgtcctctccttcatggacaagggcatccccttcatgaagatgaacatctccgtcatcatgctcctcgtctccggctggaactccatcaccgtcatgcccctcctctgcggcatcggctgcgccatgctccactggtccctcatcctccccggcatcaaggcccagcagtccaagctcgcccagcgccgcgtcttccacggcgtcgccgagaaccccgtcgtcgacggcaaccccaccgtcgacatcgaggaggcccccgagatgcccgccctctacgagaagaagctcgccctctacctcctcctcgccctctccctcgcctccgtcgccatgtgccgcacccccttctccctcgccgagggcatcgtcctcgcctccgccgccctcggccccctcatcgagggcaacacctccctcctctggaacggccccatggccgtctccatgaccggcgtcatgcgcggcaaccactacgccttcgtcggcgtcatgtacaacctctggaagatgaagaccggccgccgc

SEQ ID NO: 174 - RNA, 2715 nt, synthetic construct
  misc_feature 1..2715: note = derived and/or modified CDS sequence (opt2) from YFV 17D__NC_002031.1__NS5
  source 1..2715: mol_type = other RNA
ggctccgccaacggcaagaccctcggcgaggtctggaagcgcgagctcaacctcctcgacaagcgccagttcgagctctacaagcgcaccgacatcgtcgaggtcgaccgcgacaccgcccgccgccacctcgccgagggcaaggtcgacaccggcgtcgccgtctcccgcggcaccgccaagctccgctggttccacgagcgcggctacgtcaagctcgagggccgcgtcatcgacctcggctgcggccgcggcggctggtgctactacgccgccgcccagaaggaggtctccggcgtcaagggcttcaccctcggccgcgacggccacgagaagcccatgaacgtccagtccctcggctggaacatcatcaccttcaaggacaagaccgacatccaccgcctcgagcccgtcaagtgcgacaccctcctctgcgacatcggcgagtcctcctcctcctccgtcaccgagggcgagcgcaccgtccgcgtcctcgacaccgtcgagaagtggctcgcctgcggcgtcgacaacttctgcgtcaaggtcctcgccccctacatgcccgacgtcctcgagaagctcgagctcctccagcgccgcttcggcggcaccgtcatccgcaaccccctctcccgcaactccacccacgagatgtactacgtctccggcgcccgctccaacgtcaccttcaccgtcaaccagacctcccgcctcctcatgcgccgcatgcgccgccccaccggcaaggtcaccctcgaggccgacgtcatcctccccatcggcacccgctccgtcgagaccgacaagggccccctcgacaaggaggccatcgaggagcgcgtcgagcgcatcaagtccgagtacatgacctcctggttctacgacaacgacaacccctaccgcacctggcactactgcggctcctacgtcaccaagacctccggctccgccgcctccatggtcaacggcgtcatcaagatcctcacctacccctgggaccgcatcgaggaggtcacccgcatggccatgaccgacaccacccccttcggccagcagcgcgtcttcaaggagaaggtcgacacccgcgccaaggacccccccgccggcacccgcaagatcatgaaggtcgtcaaccgctggctcttccgccacctcgcccgcgagaagaacccccgcctctgcaccaaggaggagttcatcgccaaggtccgctcccacgccgccatcggcgcctacctcgaggagcaggagcagtggaagaccgccaacgaggccgtccaggaccccaagttctgggagctcgtcgacgaggagcgcaagctccaccagcagggccgctgccgcacctgcgtctacaacatgatgggcaagcgcgagaagaagctctccgagttcggcaaggccaagggctcccgcgccatctggtacatgtggctcggcgcccgctacctcgagttcgaggccctcggcttcctcaacgaggaccactgggcctcccgcgagaactccggcggcggcgtcgagggcatcggcctccagtacctcggctacgtcatccgcgacctcgccgccatggacggcggcggcttctacgccgacgacaccgccggctgggacacccgcatcaccgaggccgacctcgacgacgagcaggagatcctcaactacatgtccccccaccacaagaagctcgcccaggccgtcatggagatgacctacaagaacaaggtcgtcaaggtcctccgccccgcccccggcggcaaggcctacatggacgtcatctcccgccgcgaccagcgcggctccggccaggtcgtcacctacgccctcaacaccatcaccaacctcaaggtccagctcatccgcatggccgaggccgagatggtcatccaccaccagcacgtccaggactgcgacgagtccgtcctcacccgcctcgaggcctggctcaccgagcacggctgcgaccgcctcaagcgcatggccgtctccggcgacgactgcgtcgtccgccccatcgacgaccgcttcggcctcgccctctcccacctcaacgccatgtccaaggtccgcaaggacatctccgagtggcagccctccaagggctggaacgactgggagaacgtccccttctgctcccaccacttccacgagctccagctcaaggacggccgccgcatcgtcgtcccctgccgcgagcaggacgagctcatcggccgcggccgcgtctcccccggcaacggctggatgatcaaggagaccgcctgcctctccaaggcctacgccaacatgtggtccctcatgtacttccacaagcgcgacatgcgcctcctctccctcgccgtctcctccgccgtccccacctcctgggtcccccagggccgcaccacctggtccatccacggcaagggcgagtggatgaccaccgaggacatgctcgaggtctggaaccgcgtctggatcaccaacaacccccacatgcaggacaagaccatggtcaagaagtggcgcgacgtcccctacctcaccaagcgccaggacaagctctgcggctccctcatcggcatgaccaaccgcgccacctgggcctcccacatccacctcgtcatccaccgcatccgcaccctcatcggccaggagaagtacaccgactacctcaccgtcatggaccgctactccgtcgacgccgacctccagctcggcgagctcatc

SEQ ID NO: 175 - RNA, 2334 nt, synthetic construct
  misc_feature 1..2334: note = derived and/or modified CDS sequence (opt2) from YFV 17D__NC_002031.1__C-prME
  source 1..2334: mol_type = other RNA
atgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 176 - RNA, 3390 nt, synthetic construct
  misc_feature 1..3390: note = derived and/or modified CDS sequence (opt2) from YFV 17D__NC_002031.1__C-prME-NS1
  source 1..3390: mol_type = other RNA
atgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcc

SEQ ID NO: 177 - RNA, 30 nt, synthetic construct
  misc_feature 1..30: note = derived and/or modified CDS sequence (opt2) from YFV 17D__NC_002031.1__X or 10aa (5'-terminus)
  source 1..30: mol_type = other RNA
atgcgcggcctctcctcccgcaagcgccgc

SEQ ID NO: 178 - RNA, 60 nt, synthetic construct
  misc_feature 1..60: note = derived and/or modified CDS sequence (opt2) from YFV 17D__NC_002031.1__SS or ER anchor (v1)
  source 1..60: mol_type = other RNA
tcccacgacgtcctcaccgtccagttcctcatcctcggcatgctcctcatgaccggcggc

SEQ ID NO: 179 - RNA, 54 nt, synthetic construct
  misc_feature 1..54: note = derived and/or modified CDS sequence (opt2) from YFV 17D__NC_002031.1__SS or ER anchor (v2)
  source 1..54: mol_type = other RNA
gacgtcctcaccgtccagttcctcatcctcggcatgctcctcatgaccggcggc

SEQ ID NO: 180 - RNA, 72 nt, synthetic construct
  misc_feature 1..72: note = derived and/or modified CDS sequence (opt2) from YFV 17D__NC_002031.1__SS or ER anchor (v4)
  source 1..72: mol_type = other RNA
tcccacgacgtcctcaccgtccagttcctcatcctcggcatgctcctcatgaccggcggcgtcaccctcgtc

SEQ ID NO: 181 - RNA, 90 nt, synthetic construct
  misc_feature 1..90: note = derived and/or modified CDS sequence (opt2) from YFV 17D__NC_002031.1__X-SS or 10aa (5'-terminus)-SS (v1)
  source 1..90: mol_type = other RNA
atgcgcggcctctcctcccgcaagcgccgctcccacgacgtcctcaccgtccagttcctcatcctcggcatgctcctcatgaccggcggc

SEQ ID NO: 182 - RNA, 102 nt, synthetic construct
  misc_feature 1..102: note = derived and/or modified CDS sequence (opt2) from YFV 17D__NC_002031.1__X-SS or 10aa (5'-terminus)-SS (v2)
  source 1..102: mol_type = other RNA
atgcgcggcctctcctcccgcaagcgccgctcccacgacgtcctcaccgtccagttcctcatcctcggcatgctcctcatgaccggcggcgtcaccctcgtc

SEQ ID NO: 183 - RNA, 30 nt, synthetic construct; identical to SEQ ID NO: 117
  misc_feature 1..30: note = derived and/or modified CDS sequence (opt2) from YFV 17D__NC_002031.1__XX or 10aa (3'-terminus)
  source 1..30: mol_type = other RNA

SEQ ID NO: 184 - RNA, 2091 nt, synthetic construct
  misc_feature 1..2091: note = derived and/or modified CDS sequence (opt2) from YFV 17D__NC_002031.1__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 185 - RNA, 1581 nt, synthetic construct
  misc_feature 1..1581: note = derived and/or modified CDS sequence (opt2) from YFV 17D__NC_002031.1__X-SS-E
  source 1..1581: mol_type = other RNA
atgcgcggcctctcctcccgcaagcgccgctcccacgacgtcctcaccgtccagttcctcatcctcggcatgctcctcatgaccggcggcgtcaccctcgtcgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 186 - RNA, 1611 nt, synthetic construct
  misc_feature 1..1611: note = derived and/or modified CDS sequence (opt2) from YFV 17D__NC_002031.1__X-SS-E-XX
  source 1..1611: mol_type = other RNA
atgcgcggcctctcctcccgcaagcgccgctcccacgacgtcctcaccgtccagttcctcatcctcggcatgctcctcatgaccggcggcgtcaccctcgtcgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 187 - RNA, 2025 nt, synthetic construct
  misc_feature 1..2025: note = derived and/or modified CDS sequence (opt2) from YFV 17D__NC_002031.1__SS-prME
  source 1..2025: mol_type = other RNA
gacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 188 - RNA, 3081 nt, synthetic construct
  misc_feature 1..3081: note = derived and/or modified CDS sequence (opt2) from YFV 17D__NC_002031.1__SS-prME-NS1
  source 1..3081: mol_type = other RNA
gacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcc

SEQ ID NO: 189 - RNA, 273 nt, synthetic construct
  misc_feature 1..273: note = derived and/or modified CDS sequence (opt2) from YFV 17D__NC_002031.1__C (without X-SS)
  source 1..273: mol_type = other RNA
atgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctc

SEQ ID NO: 190 - RNA, 1026 nt, synthetic construct
  misc_feature 1..1026: note = derived and/or modified CDS sequence (opt2) from YFV 17D__NC_002031.1__NS1 (without XX)
  source 1..1026: mol_type = other RNA
cgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcc

SEQ ID NO: 191 - RNA, 10233 nt, synthetic construct
  misc_feature 1..10233: note = derived and/or modified CDS sequence (opt3) from YFV 17D__NC_002031.1__polyprotein
  source 1..10233: mol_type = other RNA
atgagcggcaggaaggcccaggggaaaaccctgggagtgaacatggtcaggcggggtgttcgctccctctctaataagatcaaacagaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagcctgatgagaggacttagctccaggaaacggcgctctcatgatgttctgaccgtgcagtttttgatcctcggcatgctgctgatgacaggcggggtcactctcgtgcgaaagaacagatggttactgcttaatgtaacctcggaagacttgggaaagacattctcagttggtaccggcaactgcactacaaatattctggaagcgaaatactggtgtccggatagcatggaatataactgccccaatctaagtcctagggaagaaccggacgatatcgactgttggtgctacggggtggaaaacgtccgggtggcttatggaaagtgtgattccgccggccgttctcgcagaagcaggcgggcaattgacctccccacccacgaaaatcatggtctgaaaacgcgacaggaaaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaaaggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccaaactatgaaaggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcagaccagggctgtgctatcaacttcggtaagagggaattgaaatgcggggatggaatattcatctttcgcgactccgatgactggctgaataagtactcatattaccccgaggatccagttaagctcgccagtattgtgaaagcgtctttcgaagagggcaagtgtggtctgaacagcgtagactccttagagcatgaaatgtggcggtcaagagccgacgagatcaatgctatttttgaagagaacgaagtggatatcagcgtcgtggttcaggaccctaaaaatgtgtaccaaaggggcacccaccccttctctcgaatacgcgatgggctgcagtatggatggaagacatggggcaaaaaccttgtcttttccccagggcggaagaatggaagtttcattatcgacggcaagagcagaaaagagtgccccttttctaacagggtgtggaactccttccagattgaggaatttggtactggggttttcaccacacgtgtgtacatggatgcagtctttgagtatactatcgactgtgatggatcaatattgggcgccgctgtaaacggtaagaaaagtgcccacggcagccctaccttctggatggggtcgcatgaagtgaatggaacgtggatgatccacacactcgaggcactggactacaaggaatgcgagtggccactaacccatactattggcacatccgttgaggaatctgagatgtttatgccgcgcagcatcgggggacccgtgtcaagtcacaaccacattcctggctataaagtccagaccaatggtccatggatgcaagtgcccctggaagtaaagcgggaggcgtgtcctgggacttccgtgatcatagatggaaactgcgacggcagaggcaagtctaccaggagcacaacggattccgggaaagtcattccagaatggtgctgtcgatcatgcaccatgcccccggttagcttccatggaagtgacggttgttggtaccctatggagatccggccacgcaagactcacgagtctcatctcgtgagatcctgggtgacagccggcgaaatccacgctgtccccttcgggctggtgagcatgatgattgccatggaggttgtacttaggaaacggcagggacctaagcagatgttggtgggcggtgtcgtgctgttaggggcaatgctcgttggacaagtgaccctgcttgatctgttgaaactcacagtcgctgtgggcctgcattttcacgaaatgaataacggcggggacgccatgtatatggcactaatcgccgctttctcgattcgacccggactgctcataggttttggcctgagaactctttggtcaccacgcgagaggttggtactgaccttaggggcggccatggtcgagatcgcactcggaggcgtgatgggtgggctgtggaagtaccttaacgctgtttctctgtgcattctaacgatcaatgccgtggccagtcgtaaggcttccaacacaattctccctctgatggcattgctgacccccgtcactatggccgaagtgcggttagcggctatgttcttttgtgccgttgtgatcataggagtcctccaccagaatttcaaagacaccagcatgcagaagacaatcccactggtggcacttactctgacctcttacttgggcctcacacagccgtttctgggcctatgcgccttcctggctacgagaatttttgggaggcgcagcatccctgtaaacgaggcacttgccgcggctggactcgtgggtgttctggccggcttggcattccaagaaatggagaattttctggggcccattgccgtcggaggcttactcatgatgctggtgtccgtggctggtcgagtcgatgggcttgaactgaaaaagttgggagaggtatcatgggaggaagaggccgaaatcagtggcagctctgcaagatatgacgtggctctctccgagcagggcgagttcaaactgctatcagaggagaaggttccatgggatcaggtggtcatgaccagtctggcccttgtgggggcggccctccatcccttcgcactgttgttagttctggctggatggctctttcacgtgcggggtgccaggcgcagcggcgacgtcctgtgggatatacctactccaaaaattatcgaagagtgtgaacatcttgaggacgggatctacggaattttccagtccacatttctgggcgcttctcaacgtggtgtgggggtagcacagggaggcgtgttccacaccatgtggcatgttactagaggcgcctttttggtccggaacgggaagaagctaataccctcgtgggccagcgtgaaagaagatctggtggcttatggaggttcatggaagctcgagggaaggtgggacggggaggaagaggtccagctgatcgcggcagttcctggcaagaatgtggtaaacgtgcagacaaagccgtcccttttcaaagtccgcaatggcggtgaaattggggccgtggctttagattacccaagtggcacctctggaagccccatcgttaaccgaaatggcgaggtgattgggctgtatggaaacggtatcctcgtcggcgacaattcctttgtatcagccatatctcaaacggaggtgaaggaagaggggaaggaagagttgcaggaaatccctactatgctgaaaaagggaatgaccacagttctcgatttccacccaggcgcaggtaaaaccagacggtttctgccccagattcttgccgagtgcgctaggcgcagactgaggactttggtgctagcgcctacacgggtcgtgctgagcgagatgaaggaagccttccacgggctcgacgtcaaatttcatacccaagcattcagtgctcacggctccggacgtgaggtgatcgacgccatgtgtcatgcaacattaacttaccgcatgctggaaccgacccgagttgtgaactgggaggtaattatcatggatgaagcccactttcttgaccccgctagcatagccgcgagaggctgggcagcccacagggctcgggccaatgagtctgctacgattctgatgacagcaaccccacctgggacttcagatgagttcccccattccaacggagaaatcgaggacgtgcagaccgatatcccaagtgaaccttggaacacaggtcacgactggattctcgccgataagcgccccactgcttggttcttgccaagcatcagagccgcaaatgtcatggcggcctcgctgaggaaggctggcaaatctgttgtggtcctcaaccggaagacctttgagcgagaatatccgacgataaaacagaagaaacctgacttcattctggccacagatatcgcagagatgggggctaatctttgcgtggagagagtactagactgtcgcaccgcctttaagcccgtgctggttgatgaaggaaggaaggtggcaattaaaggcccattgcggatctccgccagctcagctgcgcagcgtagaggtaggatagggcgcaaccccaatcgggacggcgatagttactactattctgagcctacttccgaaaacaatgcccatcacgtctgctggttagaggcaagcatgctgctcgacaacatggaggtgcgaggaggcatggtcgctccactgtacggggtggaaggaacaaagacccccgtttcacctggcgagatgagacttagggacgatcaacgcaaagtattccgggaactggtgagaaattgcgacctcccggtctggttgagttggcaagtggccaaggccggtctgaaaactaacgatcgtaagtggtgttttgaggggccagaagaacatgagattctaaatgacagcggagaaacagttaagtgcagggcacccggcggtgctaaaaagcctctgcggccccgctggtgtgatgagcgagtgtcctctgaccagagcgccctctccgagttcatcaaatttgcggagggcagaagaggggctgccgaagtccttgtggtactgtcagagttaccagatttcttggcaaagaaaggaggcgaggccatggacaccatctctgtgtttctgcacagtgaagaggggtcgcgggcttatcgcaacgcactcagcatgatgcctgaagccatgacgattgttatgctgttcatccttgcgggactgctcacttccggcatggtcatatttttcatgtctcccaagggtatatcaagaatgagcatggctatggggaccatggccggatgcggctacttgatgtttctgggtggcgtgaaaccaacacacatctcctatgtgatgttaattttcttcgtcctaatggttgtggtaatccctgagccggggcagcaaaggagtatccaggataatcaggtggcatacctgattataggaatcctcacccttgtctctgccgtggctgccaacgaactgggcatgttggagaagacaaaggaggacctgtttgggaaaaagaatctcattcccagctcagcatccccatggagttggcctgatctggaccttaaacccggagctgcctggactgtttatgtgggcatcgtcaccatgctcagcccaatgctgcatcactggattaaggtggaatacggtaacttgtctctgtccgggatcgcgcagtcagccagcgtattatcgttcatggataaaggaataccttttatgaagatgaatatctctgttattatgctactggtgagtggctggaactccatcacggtcatgcccctcctttgtggcattgggtgcgcaatgctgcattggagcttgatcctgccgggaataaaggctcaacagtcaaaactcgcccagcgacgggtgttccacggtgtggcagagaacccagtcgttgacggcaatcctacagtggacattgaagaggctcccgagatgccagccctgtacgaaaagaaacttgccttatatctgctcttggcgctgtccctagcttctgtagcaatgtgtcgtactccctttagcctggccgaggggatcgtgctcgctagtgccgcacttggacctctgattgaaggcaacacctccttgctgtggaatggtccgatggccgtcagcatgacaggggtgatgagaggaaaccactacgctttcgttggcgtgatgtataatctctggaagatgaaaaccggccgcagggggtctgcgaacggaaagactctgggtgaggtctggaagcgggaattaaatcttctggataaaagacagtttgagctctacaagcgcaccgacatcgtggaggtagatagggacacagcccgacggcatctagcagaaggcaaagttgatacgggggtggctgtctcaagaggaactgccaagctgaggtggttccacgagcgcggctatgtgaaattggaaggtcgtgttatagacctggggtgcggacggggcggctggtgttactatgcagccgctcaaaaggaggtgagtggggtcaagggatttaccctcggtagagatggccatgaaaaacccatgaacgtgcagtcccttgggtggaatatcattacattcaaggacaaaaccgatatccacaggctggagccagtaaagtgcgacactttgctgtgtgatattggagagagttcttcgtcaagcgtgacagaaggcgagcgcaccgtccgagttctcgacacggtggaaaaatggttagcctgcggtgtcgacaacttttgcgtgaaggtactggcgccttacatgcccgatgtgcttgagaaactggaactactccagcggagattcgggggaactgttatcaggaatcctctgtcccgcaacagtacacatgagatgtactatgtgtctggcgcaagaagcaatgtcacctttaccgtgaaccaaacttcccggttgctgatgaggcgtatgcgacgcccaacaggcaaggttaccctcgaggccgacgtcatacttcccattgggacaagatcagtggaaactgataagggacctctggacaaagaggctatcgaggaacgggtggagaggatcaagagtgaatacatgacgtcttggttctatgataatgacaacccataccgcacctggcactattgtggtagctacgtaacaaaaacttccggctcagccgcaagcatggtcaacggggtgattaagatcttaacctatccctgggatagaatagaggaagttacacggatggctatgaccgacactacgccgttcggacagcagagggtgtttaaagagaaggtcgatacccgagccaaggaccctccagctggcacacgtaaaattatgaaggtggttaatagatggctgttccgccacttggcccgggagaagaatcccaggctctgcactaaggaggagtttatcgcaaaagtgagatctcatgcggccattggtgcttacctggaagaacaggaacaatggaagaccgccaatgaggcagtacaggatcctaagttctgggagctagtcgacgaggagcgcaaacttcaccagcaggggcggtgtaggacatgcgtgtacaacatgatgggaaagcgagagaaaaagctgtccgagtttggcaaagctaagggcagtagagccatctggtatatgtggctcggggcacggtacctggagttcgaggccttgggatttctgaatgaagatcattgggcgagcagggagaactcgggtggcggggtggagggaataggcctccaatatcttggttacgttatccgcgacctggctgccatggacgggggaggcttctatgcagatgacaccgccggctgggatactcgtattacagaagctgacttagatgacgagcaggaaatcctgaattacatgtccccacaccacaagaaattggcccaggcagtcatggagatgacgtataagaacaaagtggtaaaggtgctcagacccgctccagggggaaaagcctacatggatgtcatttctcgaagggaccagcggggttcaggccaagtggttacctacgcgctgaatactatcacaaacctaaaggtgcagcttattcgcatggctgaggccgaaatggtcatccatcaccagcatgtgcaagattgtgacgagagcgttctgaccagactcgaagcatggctgaccgagcacgggtgcgataggttgaaacggatggccgtgagtggagacgactgtgtagtccgccctatagatgacagatttggcttagctctgtcccatctcaatgcaatgtctaaggtgcgaaaggatattagcgaatggcagccctcaaaaggttggaacgactgggagaatgttccattctgctcccaccactttcatgagcttcagctgaaggatgggaggcggatcgtggtcccttgtcgtgaacaggacgagctaatcggccgcggaagagtgagtcccggcaacgggtggatgattaaagaaacagcctgcctgagcaaggcgtatgccaatatgtggtctctcatgtacttccacaaaagggatatgcggttgctgtcacttgctgtatccagcgcagtgccaacttcttgggtcccccaaggaagaacgacctggagtatacatggtaagggcgagtggatgacaactgaagacatgctggaggtttggaaccgcgtgtggatcaccaacaatcctcacatgcaggataagacaatggtgaaaaagtggcgagacgtcccatatctcaccaaaaggcaggataagttatgtgggtcgctgattggaatgactaaccgggccacgtgggcttcccatatccacttggtgattcacagaatccgtacactgataggccaggagaaatacaccgactatctcactgttatggatcgctacagcgtagacgccgaccttcaactgggtgaactaatc

SEQ ID NO: 192 - RNA, 303 nt, synthetic construct
  misc_feature 1..303: note = derived and/or modified CDS sequence (opt3) from YFV 17D__NC_002031.1__C
  source 1..303: mol_type = other RNA
atgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgc

SEQ ID NO: 193 - RNA, 363 nt, synthetic construct
  misc_feature 1..363: note = derived and/or modified CDS sequence (opt3) from YFV 17D__NC_002031.1__C-ER anchor
  source 1..363: mol_type = other RNA
atgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgctctcatgatgttctgaccgtgcaatttttgatcctcggcatgctgctgatgacaggcggg

SEQ ID NO: 194 - RNA, 267 nt, synthetic construct
  misc_feature 1..267: note = derived and/or modified CDS sequence (opt3) from YFV 17D__NC_002031.1__pr
  source 1..267: mol_type = other RNA
gtgaccctggtcagaaagaacaggtggctccttctgaatgttacaagcgaggacttgggcaaaactttctccgtggggacgggaaactgcaccacaaatatcttagaagccaagtactggtgtcccgattctatggagtataactgccctaatctgtcaccacgggaggaaccggacgatattgactgttggtgctacggtgtagaaaacgtgcgcgtcgcttatggcaaatgtgatagtgcagggcgaagccgtagatccaggcgg

SEQ ID NO: 195 - RNA, 225 nt, synthetic construct
  misc_feature 1..225: note = derived and/or modified CDS sequence (opt3) from YFV 17D__NC_002031.1__M
  source 1..225: mol_type = other RNA
gccatcgacctgcccacccacgagaaccatggcctcaagacaagacaggaaaaatggatgactgggaggatgggagagcggcaacttcagaagattgaacgctggttcgtgcgaaatccatttttcgctgtcacggcactgaccatagcctacttggttggtagcaacatgacacagcgtgtggtaatcgcgttactggtgctagctgtcggccctgcctattcc

SEQ ID NO: 196 - RNA, 492 nt, synthetic construct
  misc_feature 1..492: note = derived and/or modified CDS sequence (opt3) from YFV 17D__NC_002031.1__prM
  source 1..492: mol_type = other RNA
gtgaccctggtcagaaagaacaggtggctccttctgaatgttacaagcgaggacttgggcaaaactttctccgtggggacgggaaactgcaccacaaatatcttagaagccaagtactggtgtcccgattctatggagtataactgccctaatctgtcaccacgggaggaaccggacgatattgactgttggtgctacggtgtagaaaacgtgcgcgtcgcttatggcaaatgtgatagtgcagggcgaagccgtagatccaggcgggccatagacctacccactcacgagaatcatggactcaagacccgccaggagaaatggatgacaggcagaatgggtgaaaggcaactgcagaagatcgagcggtggtttgtgcgcaaccctttctttgcggttaccgctcttactattgcctacctggtggggtctaatatgacacagcgagtcgtgatcgcattgctcgtactggccgttggaccagcttattcg

SEQ ID NO: 197 - RNA, 1479 nt, synthetic construct
  misc_feature 1..1479: note = derived and/or modified CDS sequence (opt3) from YFV 17D__NC_002031.1__E
  source 1..1479: mol_type = other RNA
gcccactgcatcggcattaccgacagagatttcatagagggggtgcatggaggtacatgggtcagcgctactctggaacaggacaagtgtgttacggtgatggcacccgataaaccttccctcgacatctctcttgagaccgtagccattgataggccagcggaagtgcggaaggtctgctacaacgctgtgctgacacacgttaaaatcaatgacaagtgtccgtcaactggcgaggcccatttggcagaagagaacgagggggataatgcctgcaaacgcacctatagtgaccgaggatggggcaacggttgtgggttatttggaaagggcagcattgtggcttgcgcaaagttcacatgtgccaaatccatgtctctgtttgaagtcgatcaaaccaagatccagtacgtgatacgtgctcagctacacgtaggcgccaaacaggagaattggaacactgacatcaagacactcaaattcgatgcgctgtcggggtcacaagaagttgagtttattggatatggtaaggcaacccttgagtgccaggtgcagacggccgtcgacttcggcaatagctacatcgctgaaatggagactgaaagttggattgtggatagacagtgggcccaagacctgaccttgccctggcagtccgggtctggaggcgtgtggagggagatgcatcacctcgtcgaatttgagcctccacacgcagctacaatccgggttctggccctgggtaaccaggaggggagcctcaagactgcgttaaccggagccatgcgcgtgacaaaagacaccaatgataacaatctgtataaacttcatggcggccacgtatcctgtagagtgaagttgtcagcactgacgctaaaggggacaagttacaaaatatgcactgacaagatgttctttgtcaaaaaccccaccgatactggacatggtacagtggttatgcaagtgaaggtcagcaagggcgctccttgtaggattccagtgatcgtagccgacgatctcaccgctgccattaataaagggatcctggttacggtgaaccccatcgcatctaccaatgacgatgaagtccttattgaggtgaaccctccattcggagactcctatataatcgtcggccggggtgattcacgcctgacataccagtggcacaaggaagggagcagtattggcaaattgtttactcagaccatgaagggagtggagcgactcgccgttatgggcgacacagcttgggatttctcttccgcagggggatttttcactagcgtgggtaaaggcatccacaccgtattcgggtcggcgtttcagggactgttcggcggtttaaactggataacaaaggtcattatgggggccgtgctgatctgggttggcatcaataccagaaacatgactatgtctatgtccatgattctcgtgggagtcatcatgatgtttctttcactgggcgtgggggct

SEQ ID NO: 198 - RNA, 1971 nt, synthetic construct
  misc_feature 1..1971: note = derived and/or modified CDS sequence (opt3) from YFV 17D__NC_002031.1__prME
  source 1..1971: mol_type = other RNA
gtgaccctggtcagaaagaacaggtggctccttctgaatgttacaagcgaggacttgggcaaaactttctccgtggggacgggaaactgcaccacaaatatcttagaagccaagtactggtgtcccgattctatggagtataactgccctaatctgtcaccacgggaggaaccggacgatattgactgttggtgctacggtgtagaaaacgtgcgcgtcgcttatggcaaatgtgatagtgcagggcgaagccgtagatccaggcgggccatagacctacccactcacgagaatcatggactcaagacccgccaggagaaatggatgacaggcagaatgggtgaaaggcaactgcagaagatcgagcggtggtttgtgcgcaaccctttctttgcggttaccgctcttactattgcctacctggtggggtctaatatgacacagcgagtcgtgatcgcattgctcgtactggccgttggaccagcttattcggcacactgcattggcatcaccgatagagacttcatagaaggcgtgcatgggggaacgtgggtctcagccactctggagcaggataagtgtgtgaccgtgatggctcccgacaaacctagcctcgatatcagtttagagacagtcgccattgacaggccagcggaagttcggaaggtgtgctacaacgcagtactgactcacgtgaaaatcaatgataagtgtccctccaccggtgaggcccatcttgctgaagagaacgaaggcgacaatgcctgcaaacgtacatattctgaccgcgggtggggaaacggctgtggtttgtttgggaagggaagcattgtcgcatgcgctaagtttacctgcgccaaatccatgtcactgttcgaggtggatcaaacgaagatccagtacgttataagagcgcagctacacgtgggcgccaaacaggagaattggaacactgacattaagacactcaaattcgatgcactgagtggcagccaagaagtcgagtttatcgggtacggaaaggctacccttgaatgtcaggtgcagactgccgtagacttcggtaactcttatattgctgagatggaaacagagtcctggatcgttgataggcagtgggcccaagacctgaccttgccttggcagtcaggcagcgggggagtgtggcgggagatgcaccatctcgtcgaatttgagccaccgcacgcagccacgatccgagtgctggctttaggcaatcaggaaggtagtctgaaaaccgcgctcacaggggcaatgcgcgtcactaaggataccaacgacaataacctttacaagctgcatggcggacacgtgtcttgcagagttaaattgtccgccctaacactgaagggcactagctataaaatttgtaccgataagatgttctttgtgaaaaatcccacagacaccgggcacggaactgtagtcatgcaagtgaaggtttcgaagggtgctccttgcaggataccagtgatcgtcgccgatgacctcacggcagccattaacaaaggcatcctggtgacagtaaatcccatagcttctaccaacgacgatgaggtgcttattgaagttaatcctccattcggggactcctacatcatcgtcggacggggcgattcacgcctgacttatcagtggcataaggagggtagtagcattgggaaattgttcacccagacaatgaagggcgtggagagactcgccgtgatgggagacaccgcatgggatttttcctctgcgggcgggttctttactagcgtcggaaaaggtatccacacagttttcggctcagcttttcaggggctgttcggaggcttaaactggattacgaaggtgataatgggtgccgtgctgatctgggtagggattaataccaggaacatgactatgagtatgtccatgatcctagtcggcgtgatcatgatgtttctcagcctgggagttggcgca

SEQ ID NO: 199 - RNA, 2031 nt, synthetic construct
  misc_feature 1..2031: note = derived and/or modified CDS sequence (opt3) from YFV 17D__NC_002031.1__ER anchor-prME
  source 1..2031: mol_type = other RNA
agccacgacgtgctgaccgtccagttcctcatccttggcatgctgttgatgacagggggagttactttagtgagaaagaacaggtggctgctactcaatgtaacgtccgaggatctgggtaaaaccttttctgtgggcacagggaactgcactaccaatattcttgaagccaagtactggtgtcccgactcaatggagtataactgccctaatctgagtccacgggaggaaccggatgacatagattgttggtgctacggagtcgaaaacgtgcgcgttgcttatggcaaatgtgacagcgcaggtcgatcccgtagatctaggcgggccatcgatttgcccacacatgagaatcacgggctcaagacccgccaagagaaatggatgactggaagaatgggcgaaaggcagctgcagaagattgagcggtggttcgtgcgcaaccctttcttcgcggtcacagctctgaccatcgcctacctcgtgggctcgaatatgacgcagcgagtagttattgcattactggtgcttgccgtcgggccagcttattcagcacattgcatcggaataactgacagagattttatcgaaggtgtgcacggcgggacctgggtgagcgccacattggagcaagacaagtgtgtcactgttatggctcccgataaacctagtctggacatttccctagagaccgtggccatcgataggccagcggaagtacggaaggtgtgctacaacgcagtcctcacacatgtgaaaattaatgacaagtgtccctctaccggagaggcccacctggctgaagagaacgaaggcgacaatgcctgcaaacgtacgtatagcgatcgcggttgggggaacggatgtggccttttcggcaaggggtccatcgttgcatgcgctaagtttacttgcgccaaatcaatgagtctgttcgaggtggaccagacaaagatacagtacgtcattagagcgcagttgcacgtgggagccaaacaagagaattggaacaccgatatcaagactctcaaatttgacgcactgagcggttctcaggaagtagagttcattggctacgggaaggctacattagaatgtcaggttcagaccgccgtggattttggaaactcctatatcgctgagatggaaacggagtcatggatcgtcgacaggcaatgggcccaggatctgaccctcccttggcagagcggcagtggtggggtgtggcgggagatgcatcaccttgtcgaatttgagccaccgcatgcagccacaattcgagtgctggctttgggcaatcaagaaggatctctaaaaactgcgctgaccggcgcaatgcgcgttacaaaggacactaacgataataacctctacaagctgcacgggggacacgtgtcctgcagagtaaaacttagcgccctgaccttgaagggtacatcgtataaaatatgtaccgacaagatgtttttcgtcaaaaatcccactgatacgggccatgggacagtggttatgcaagtgaaggtctctaagggagctccttgcaggatcccagtgattgtagccgacgacctcaccgcagccatcaacaaaggcatactggtgactgttaatcccattgcttccaccaacgatgacgaggtcttaatcgaagtgaatcctccattcggtgattcatacatcattgtggggcggggcgacagtcgcctgacatatcagtggcacaaggagggaagctccatcggcaaactatttacccagactatgaagggggtcgagagactcgccgttatgggagatacagcatgggacttctctagcgcgggtggctttttcacgtcagtggggaaaggcattcataccgtgtttggaagtgctttccagggtctgtttgggggccttaactggataactaaggtaatcatgggagccgtcttgatttgggtgggcatcaatacaaggaacatgaccatgtccatgagcatgatcctggttggggtgattatgatgttcctctctctgggagtcggcgca

SEQ ID NO: 200 - RNA, 1056 nt, synthetic construct
  misc_feature 1..1056: note = derived and/or modified CDS sequence (opt3) from YFV 17D__NC_002031.1__NS1
  source 1..1056: mol_type = other RNA
gaccagggctgcgccatcaacttcgggaagagagagctgaaatgtggagatggtatttttatattcagggacagcgatgactggctcaataagtactcctattaccccgaagatcctgtgaaacttgcttctatcgtcaaggcatcatttgaggaaggcaaatgcgggctgaacagtgttgacagcttggagcacgaaatgtggcggtcccgcgccgatgagattaatgcgatcttcgaggaaaacgaggtggacatttctgtagtggtccaagatccaaagaatgtgtatcagcgaggaacccatccgttttcgcgtatcagagacggcttacagtacggttggaagacatgggggaaaaacctggttttctcacccggaaggaagaatggcagctttataatcgatggcaaaagtcggaaggaatgtcctttctccaaccgcgtgtggaactcttttcagattgaggagttcgggactggagtctttacgaccagagtgtatatggacgctgtattcgaatacacaatcgattgcgacggtagcattctaggcgccgcagttaatgggaaaaagtccgcccacggatcaccaactttttggatgggcagtcatgaggtgaatggtacctggatgatccacacactcgaagctctggactataaggagtgtgaatggccccttacccatactatagggacaagcgtcgaggagtctgaaatgttcatgcctaggtccattggaggcccagtgtcaagccacaaccacatccccggctacaaagtgcaaaccaatgggccttggatgcaggtcccactggaggttaagcgggaagcatgcccgggaacgagtgtgattatcgatggtaactgtgacggccgcgggaaatctactcgatccaccacagatagcggaaaggtaatccccgagtggtgctgtagatcgtgcactatgcctccagtgtctttccatggctccgacggttgttggtaccccatggaaattaggcctcggaaaacccacgagtcacatttggtccgtagttgggtgacagcc

SEQ ID NO: 201 - RNA, 672 nt, synthetic construct
  misc_feature 1..672: note = derived and/or modified CDS sequence (opt3) from YFV 17D__NC_002031.1__NS2A
  source 1..672: mol_type = other RNA
ggcgagatccacgccgtgcccttcgggctggtcagcatgatgattgctatggaagttgtgctcagaaagaggcagggacctaaacaaatgcttgtaggtggcgtggtcctgttgggggcaatgttagtgggacaggttaccctgctagacctcctgaaacttacagtggccgtcggcctgcattttcacgagatgaacaatggtggggatgcgatgtacatggctttgatagccgcattctccatccggccaggactcctgattggctttggcctgcgcactctctggtctccgcgagaacgtttagtgctgacgcttggggccgctatggtagagatcgcattgggaggtgttatgggcgggctgtggaagtatctaaacgccgtgtcactctgcattctgaccatcaatgctgtcgccagtagaaaggcgagcaacacaatacttcccctgatggcattgctcactcctgtgaccatggccgaagtgaggctggctgccatgttcttttgtgcagtcgttatcattggagtgttacatcagaatttcaaagacacatccatgcagaagaccatcccactggtagctctcactcttacatcttacctgggcttgacccaaccctttctaggtctgtgcgccttcctcgcgacgcggatttttgggcgcaga

SEQ ID NO: 202 - RNA, 390 nt, synthetic construct
  misc_feature 1..390: note = derived and/or modified CDS sequence (opt3) from YFV 17D__NC_002031.1__NS2B
  source 1..390: mol_type = other RNA
agcatccccgtgaacgaggccctggctgcagccggcctcgtcggggttcttgcgggactggctttccaggaaatggagaatttcttgggtcctattgccgtgggcgggttactgatgatgctagtatccgtggcaggaagagtcgacggcctcgaactgaagaaacttggtgaggtgtcttgggaagaggaggccgaaatatcagggagtagcgctaggtacgatgttgcactgtccgagcaaggagaatttaagttgctctctgaggagaaagtgccatgggaccaggtcgtgatgacctcgctggccctggtaggcgctgccctccacccgtttgcgttactgcttgttttggcaggctggctgttccatgtgcgcggggcccggcga

SEQ ID NO: 203 - RNA, 1869 nt, synthetic construct
  misc_feature 1..1869: note = derived and/or modified CDS sequence (opt3) from YFV 17D__NC_002031.1__NS3
  source 1..1869: mol_type = other RNA
agcggcgacgtgctgtgggatatccccacccctaagattatagaggaatgcgagcacctcgaagacgggatctacggaattttccagtccacatttcttggtgcctctcaaagaggcgtcggggttgctcagggaggcgtgttccatactatgtggcacgtaacgaggggtgcatttctggtgcggaacgggaaaaagttgatcccatcatgggccagtgtcaaagaggatttagtggcgtatggaggcagctggaagctggaaggccgctgggacggggaggaggaagttcagctaattgctgccgtgccgggtaaaaatgtcgtgaacgtacagaccaagccctccctcttcaaggttcgaaatggaggcgagatcggggcagtggccctggattacccttctggaacatcgggctcaccaatagtcaaccgtaatggtgaagtgatcgggctttatggaaacggcattctggtgggcgacaatagctttgtcagtgctatctcccaaactgaggttaaagaggaagggaaggaggaattgcaggagattcccaccatgctcaaaaagggaatgacaaccgtgctggatttccatcctggtgcaggcaaaactagaaggtttctgccacagatcctcgccgaatgtgctcggcgcagattaaggacactggtacttgcccccacccgggtggtcttgtctgagatgaaggaggcgttccacgggctggacgtgaagtttcatacgcaggcattcagcgcccacggatccggccgcgaagttatagatgctatgtgccacgccactctaacctaccgaatgctcgagcctacaagagtggtcaactgggaagtgattatcatggacgaggcacattttctggatccagcttcaattgccgcgaggggttgggccgcacaccgggctcgtgccaatgaaagtgctactatccttatgaccgccacaccgcccgggaccagcgacgagttccctcattctaacggcgagatcgaagatgtacaaacggacattccatccgagccctggaatactggacacgactggatactggcagataaacgccctacagcctggtttttgccatcaatcagagctgcgaacgttatggcagccagcctcaggaaggctggcaaaagtgtggtcgtgctgaatcggaagaccttcgaacgagagtatcccactattaaacagaagaaaccggacttcatcttagccacagatatagcagaaatgggggccaacctgtgtgtcgagcgcgtgctcgactgcagaaccgcttttaagcctgttcttgtggatgagggaaggaaggtagccattaaaggtcccctgcggatctctgcatccagcgcggctcagcgcagaggcaggatcgggcgtaatccaaaccgggacggagattcgtactattactctgaacctacgtccgagaacaatgcccaccatgtctgttggttggaagcatcaatgctactggacaacatggaggtgcgaggcggtatggttgctcccctctacggggtggagggcaccaagacaccagtcagtcccggagaaatgagactgagggatgaccagcgcaaagtgttccgggagcttgtaagaaattgcgatctgcctgtgtggttgagctggcaagttgccaaggccggcctcaaaactaacgacaggaagtggtgttttgaagggccagaggaacacgagattctgaatgactccggagagaccgtcaagtgccgcgcaccgggtggcgctaaaaagcccttacgacctcggtggtgtgatgaacgtgtgtctagcgaccagtcagccctgagtgagttcatcaaatttgcggaagggagaagg

SEQ ID NO: 204 - RNA, 447 nt, synthetic construct
  misc_feature 1..447: note = derived and/or modified CDS sequence (opt3) from YFV 17D__NC_002031.1__NS4A-P2K
  source 1..447: mol_type = other RNA
ggcgccgctgaggtgctggtcgttctcagcgaacttcccgacttcctggcaaagaaagggggagaggccatggataccatctccgtgtttttgcactctgaagagggttcaagagcgtacaggaacgctttaagtatgatgcctgaagccatgacaattgtaatgctgttcatactagcaggcctcctgactagcgggatggtgatctttttcatgtccccaaagggaatttctcggatgtcgatggccatgggcacgatggctggttgcgggtatcttatgtttctgggaggcgtcaaaccgacccatatctcatacgtgatgttgattttctttgttctcatggtggtcgtgatccccgagcctggccagcaacgcagcatacaggacaatcaggtagcatatctgatcattgggatcctgacactcgttagtgccgtggctgcc

SEQ ID NO: 205 - RNA, 750 nt, synthetic construct
  misc_feature 1..750: note = derived and/or modified CDS sequence (opt3) from YFV 17D__NC_002031.1__NS4B
  source 1..750: mol_type = other RNA
aacgagctgggcatgctcgaaaagaccaaagaggaccttttcgggaagaaaaatctgatccccagctccgcctctccttggtcatggccagatttggacttaaagccgggagctgcatggacagtgtacgtcggtattgttactatgctgagtcccatgctacaccattggataaaagtggaatatggcaacctcagcctgtccgggatcgcccagtctgcgtcggtactttcatttatggataagggcattcctttcatgaagatgaatatcagcgtgattatgctgttggtcagtggatggaactccatcacggtgatgccactcctgtgcggtatagggtgtgctatgctgcactggtctctcatcttacccggaattaaagcccaacagagcaagctggcacagagaagggtttttcatggcgtggccgagaatcctgtcgtggacggcaacccaaccgtagatatcgaagaggctcccgagatgcctgcactttacgagaaaaagttggccctgtatctactcctggctctttccctggcctcagttgcgatgtgccggacaccattcagtttggcagaagggattgtgctcgccagcgctgccctgggaccgttaatcgaaggtaatacttctctgctctggaacggccccatggcagtctccatgaccggggtgatgcgcggaaatcactacgcttttgtgggcgtcatgtataacctttggaaaatgaagacaggtcgacgt

SEQ ID NO: 206 - RNA, 2715 nt, synthetic construct
  misc_feature 1..2715: note = derived and/or modified CDS sequence (opt3) from YFV 17D__NC_002031.1__NS5
  source 1..2715: mol_type = other RNA
ggcagcgccaacgggaagaccctgggagaggtgtggaaaagagaactcaatcttctggacaagaggcagttcgagttgtacaaacggacagatatcgtcgaagttgaccgcgatactgctcgacgtcacttagcagagggtaaggtggacacgggcgtagccgtgtccagagggaccgcgaaactgaggtggtttcatgaacggggatatgtcaagctagagggccgcgtgattgatctcggttgcgggagaggaggctggtgttactatgctgccgcacaaaaggaggtttctggcgtgaaagggttcacactgggaagggacggtcacgaaaagcccatgaacgtccagtcacttggctggaatataatcacttttaaagataagaccgacattcatcggctggagcctgtgaaatgcgatacattgctctgtgacatcggggaaagtagctcctcttcggtaaccgagggagagcgcactgttcgagtgctggatacagtcgaaaagtggctggcctgcggcgtggacaacttctgtgtgaaggtcctcgctccatacatgccggatgttttagagaaactggaacttttgcagagaaggtttggtgggaccgtgattcggaatcccctgtcacgtaacagcacgcacgagatgtattacgtaagtggagcacgctccaatgtgactttcaccgtcaaccagacatctagactactcatgaggcggatgcgacgccctactggcaaggtgaccctggaagccgacgttatccttccaataggcacaagaagcgtggagaccgacaaagggcccctggataaggaggctatcgaagagagggtcgaacggattaaatccgagtatatgacgtcatggttttacgacaatgataacccttaccgcacttggcattattgcggaagttacgtgacaaagaccagcggttctgccgcgtccatggtaaatggcgttatcaaaattttgacttatccatgggacagaatcgaagaggtgacaaggatggcaatgaccgatacgacccccttcgggcaacagcgtgtctttaaggagaaggtggacacacgggccaaagatcctccagctggaactcgaaagataatgaaagtcgtgaacagatggctgttcaggcacctcgcccgcgaaaagaatccgcggttatgtaccaaagaggaatttattgcaaaggttagatcacacgctgccatcggcgcgtacctggaggaacaggagcagtggaagacagccaacgaggcagtgcaagaccccaaattctgggaactcgtagatgaggaaaggaaacttcatcagcagggtcgctgccgaacttgtgtctataatatgatggggaaacgggagaagaaactgagcgagtttggcaaggctaagggaagtcgtgccatttggtacatgtggttgggcgctagatatctagagttcgaagccctggggttcctcaacgaagaccactgggcatctagggagaactccggaggtggcgtggaagggatcggactgcagtaccttggctacgttatccgcgatctggccgctatggacggtgggggcttttatgcggacgataccgcaggatgggacacacggattaccgaggccgatttggacgatgagcaagaaatactcaattacatgagccctcatcacaaaaagctggctcaggccgtgatggagatgacttataaaaacaaggtcgtgaaagtattaagaccagcacccggcgggaaggcctacatggacgtgatctcgaggcgagatcagcgcggatctggtcaagttgtcacgtatgctctgaatacaattaccaacctaaaggtgcagctcatccggatggccgaagcagagatggtgatacaccatcagcacgtccaggactgcgatgaatccgttctgactagacttgaggcgtggttgaccgagcatggctgtgacaggctgaaacgtatggctgtgtcaggggatgactgcgtggtacgccctattgatgaccggttcggactcgccctgagtcaccttaatgcaatgagcaaggtcagaaaagacatctccgaatggcaaccatctaagggctggaacgattgggagaatgtgcccttttgcagccatcacttccacgaactgcagttgaaagacggtaggcgaatcgttgtgccgtgtcgggagcaggatgaactcattgggcgcggcagagtctcacctggaaacggctggatgatcaaggagacagcctgcctgagtaaggcttacgccaatatgtggtccttaatgtattttcataagagggacatgcggctgctaagcctcgcagtgtcttcagctgttcccaccagttgggtgccacaggggcgaactacatggagcattcacggaaagggcgagtggatgacgaccgaagatatgctggaggtatggaacagagtctggataactaataaccctcatatgcaagacaaaacaatggtgaagaaatggcgcgatgtgccctaccttaccaagaggcaggacaaattgtgtggttccctgatcgggatgacaaatcgtgccacttgggcgtctcacattcacctcgtcatccatcggatcagaaccctgattggacaggaaaagtacacggattatttaaccgttatggacaggtactcggtggatgccgacctgcagcttggcgagttgata

SEQ ID NO: 207 - RNA, 2334 nt, synthetic construct
  misc_feature 1..2334: note = derived and/or modified CDS sequence (opt3) from YFV 17D__NC_002031.1__C-prME
  source 1..2334: mol_type = other RNA
atgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgctctcatgatgttctgaccgtgcaatttttgatcctcggcatgctgctgatgacaggcggggtcactctcgtgcgaaagaacagatggttactgcttaatgtaacctcggaggacttgggaaagacattctcagttggtaccggcaactgcactacaaatattctggaagcgaaatactggtgtccggatagcatggagtataactgccccaatctaagtcctagggaagaaccagacgatatcgactgttggtgctacggggtggaaaacgtccgggtggcttatggaaagtgtgattccgccggccgttctcgcagaagcaggcgggcaatagacctccccacccacgagaatcatggtctgaaaacgcgacaggagaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaagggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccagactatgaagggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagca

SEQ ID NO: 208 - RNA, 3390 nt, synthetic construct
  misc_feature 1..3390: note = derived and/or modified CDS sequence (opt3) from YFV 17D__NC_002031.1__C-prME-NS1
  source 1..3390: mol_type = other RNA
atgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgctctcatgatgttctgaccgtgcaatttttgatcctcggcatgctgctgatgacaggcggggtcactctcgtgcgaaagaacagatggttactgcttaatgtaacctcggaggacttgggaaagacattctcagttggtaccggcaactgcactacaaatattctggaagcgaaatactggtgtccggatagcatggagtataactgccccaatctaagtcctagggaagaaccagacgatatcgactgttggtgctacggggtggaaaacgtccgggtggcttatggaaagtgtgattccgccggccgttctcgcagaagcaggcgggcaatagacctccccacccacgagaatcatggtctgaaaacgcgacaggagaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaagggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccagactatgaagggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcagaccagggctgtgctatcaacttcggtaagagggaattgaaatgcggggatggaatattcatctttcgcgactccgatgactggctgaataagtactcatattaccccgaggatccagttaagctcgccagtattgtgaaagcgtctttcgaagagggcaagtgtggtctgaacagcgtagactccttagagcatgaaatgtggcggtcaagagccgacgagatcaatgctatttttgaagagaacgaagtggatatcagcgtcgtggttcaggaccctaaaaatgtgtaccaaaggggcacccaccccttctctcgaatacgcgatgggctgcagtatggatggaagacatggggcaaaaaccttgtcttttccccagggcggaagaatggaagtttcattatcgacggcaagagcagaaaagagtgccccttttctaacagggtgtggaactccttccagattgaggaatttggtactggggttttcaccacacgtgtgtacatggatgcagtctttgagtatactatcgactgtgatggatcaatattgggcgccgctgtaaatggtaagaaaagtgcccacggcagccctaccttctggatggggtcgcatgaagtgaatggaacgtggatgatccacacactcgaggcactggactacaaggaatgcgagtggccactaacccatactattggcacatccgttgaggaatctgagatgtttatgccgcgcagcatcgggggacccgtgtcaagtcacaaccacattcctggctataaagtccagaccaatggtccatggatgcaagtgcccctggaagtaaagcgggaggcgtgtcctgggacttccgtgatcatagatggaaactgcgacggcagaggcaagtctaccaggagcacaacggattccgggaaagtcattccagaatggtgctgtcgatcatgcaccatgcccccggttagcttccatggaagtgacggttgttggtaccctatggagatccggccacgcaagactcacgagtctcatctcgtgagatcctgggtgacagcc

SEQ ID NO: 209 - RNA, 30 nt, synthetic construct
  misc_feature 1..30: note = derived and/or modified CDS sequence (opt3) from YFV 17D__NC_002031.1__X or 10aa (5'-terminus)
  source 1..30: mol_type = other RNA
atgagaggcctgagctccaggaagcggcgc

SEQ ID NO: 210 - RNA, 60 nt, synthetic construct
  misc_feature 1..60: note = derived and/or modified CDS sequence (opt3) from YFV 17D__NC_002031.1__SS or ER anchor (v1)
  source 1..60: mol_type = other RNA
agccacgacgtgctgaccgtccagttcctcatccttggcatgctgttgatgacaggggga

SEQ ID NO: 211 - RNA, 54 nt, synthetic construct
  misc_feature 1..54: note = derived and/or modified CDS sequence (opt3) from YFV 17D__NC_002031.1__SS or ER anchor (v2)
  source 1..54: mol_type = other RNA
gacgtgctgaccgtccagttcctcatccttggcatgctgttgatgacaggggga

SEQ ID NO: 212 - RNA, 72 nt, synthetic construct
  misc_feature 1..72: note = derived and/or modified CDS sequence (opt3) from YFV 17D__NC_002031.1__SS or ER anchor (v4)
  source 1..72: mol_type = other RNA
agccacgacgtgctgaccgtccagttcctcatccttggcatgctgttgatgacagggggagttactttagtg

SEQ ID NO: 213 - RNA, 90 nt, synthetic construct
  misc_feature 1..90: note = derived and/or modified CDS sequence (opt3) from YFV 17D__NC_002031.1__X-SS or 10aa (5'-terminus)-SS (v1)
  source 1..90: mol_type = other RNA
atgagaggcctgagctccaggaagcggcgctctcacgacgtgctcaccgtccagttccttatcctggggatgttgttaatgacaggaggt

SEQ ID NO: 214 - RNA, 102 nt, synthetic construct
  misc_feature 1..102: note = derived and/or modified CDS sequence (opt3) from YFV 17D__NC_002031.1__X-SS or 10aa (5'-terminus)-SS (v2)
  source 1..102: mol_type = other RNA
atgagaggcctgagctccaggaagcggcgctctcacgacgtgctcaccgtccagttccttatcctggggatgttgttaatgacaggaggtgttactctggtg

SEQ ID NO: 215 - RNA, 30 nt, synthetic construct; identical to SEQ ID NO: 118
  misc_feature 1..30: note = derived and/or modified CDS sequence (opt3) from YFV 17D__NC_002031.1__XX or 10aa (3'-terminus)
  source 1..30: mol_type = other RNA

SEQ ID NO: 216 - RNA, 2091 nt, synthetic construct
  misc_feature 1..2091: note = derived and/or modified CDS sequence (opt3) from YFV 17D__NC_002031.1__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaacaccgatatcaaaactctgaagtttgacgcattatccggctcacaggaagtagagttcattgggtacggaaaagctacactggaatgtcaggttcagaccgccgtggattttggcaacagctatatcgctgagatggaaacggagagttggatcgtcgacagacaatgggcccaggatctcacccttccttggcagtctggttccgggggcgtgtggagggagatgcatcacctggtcgaatttgagccaccgcatgcagccacaattcgggtgttggctctaggaaatcaagaaggcagcctgaagactgcgctcaccggggcaatgcgcgttacaaaggacactaacgataataacctgtacaaacttcacggaggtcacgtgtcgtgcagagtaaagctgtctgccttgaccctcaaaggcacatcctataagatatgtaccgacaaaatgtttttcgtcaagaatcccactgatacggggcatggaacagtggttatgcaagtgaaggtctcaaaaggcgctccttgcaggatcccagtgattgtagccgacgacctgaccgcagccatcaacaagggtatattagtgactgttaatcccattgctagtaccaacgatgacgaggtcctgatcgaagtgaatcctccattcggggatagctacatcattgtgggccgtggagactcccggctaacatatcagtggcacaaagagggctctagcatcgggaagctctttacccagactatgaaaggagtcgagcgactggccgttatgggtgatacagcatgggacttctcaagtgcgggcgggtttttcacgtccgtgggaaagggcattcataccgtgtttggtagcgctttccaggggctttttggcggattgaactggataactaaggtaatcatgggcgccgtcctgatttgggtggggatcaatacaagaaacatgaccatgtctatgtcaatgatcctcgttggagtgattatgatgttcctgagtcttggcgtcggtgcagatcaggggtgtgccataaattttggaaaa

SEQ ID NO: 217 - RNA, 1581 nt, synthetic construct
  misc_feature 1..1581: note = derived and/or modified CDS sequence (opt3) from YFV 17D__NC_002031.1__X-SS-E
  source 1..1581: mol_type = other RNA
atgagaggcctgagctccaggaagcggcgctctcacgacgtgctcaccgtccagttccttatcctggggatgttgttaatgacaggaggtgttactctggtggcccattgcattggcataacggatcgagactttatcgagggggtacacggaggcacctgggtgtcagctacactagaacaagataaatgtgtcactgtgatggcacccgacaagcctagtctcgatattagcctggagaccgttgccatcgaccgtccagcggaagtgagaaaagtctgctacaacgctgtgcttacacatgtaaagattaatgataaatgtccgtccaccggtgaggcccacctggcagaagagaacgagggggacaatgcctgcaagaggacttattctgatcggggatggggcaacggctgtgggttgttcggaaagggttcgatcgttgcttgcgcaaaatttacatgtgccaagtcaatgagcctcttcgaagtggaccagaccaaaatacagtacgtcatccgcgctcagctgcatgtgggcgccaagcaagagaattggaacacggatattaaaactctgaagtttgacgcgctcagtgggtcccaggaagtggagttcatcggatatggcaaggcaaccttagagtgccaggtccagacagccgttgattttggtaattcttacattgctgaaatggagactgaaagctggatcgtggacagacaatgggcccaggacctgacccttccctggcagtccgggtcaggaggcgtatggagggagatgcaccacttggtggagttcgaacctccacatgcagctacaatacgggtcctggccctaggcaaccaggaggggagtctcaaaaccgcgctgacgggagccatgcgcgtgactaaggatacaaatgacaacaatctttataaactgcacggtggccatgttagctgtcgagtgaagttgtctgcactcaccctgaaagggacttcctacaagatttgcacagataaaatgtttttcgtcaagaaccccaccgacacgggacacggcaccgtggtaatgcaagttaaggtgtcaaaaggtgctccttgtagaatcccagtcattgtggccgatgacttaacagctgccatcaataaggggatcctggtcactgtgaaccccattgcaagcaccaatgatgacgaagttctcatagaggtgaaccctccatttggcgatagttatatcattgtaggaaggggcgactctcggcttacataccagtggcacaaagaagggtccagcatcggaaagctgttcactcagaccatgaaaggtgtcgagcgtttggccgtgatgggcgatacagcttgggacttttcgtctgcagggggattcttcacctccgttggcaagggtatacatactgtgtttgggtcagcgttccaaggcctatttggaggcctgaactggattacgaaggtcatcatgggggccgtgctcatctgggtaggaattaatacacgcaacatgaccatgagtatgagcatgatcctggtgggtgttattatgatgttcctttccctgggcgtcggggct

SEQ ID NO: 218 - RNA, 1611 nt, synthetic construct
  misc_feature 1..1611: note = derived and/or modified CDS sequence (opt3) from YFV 17D__NC_002031.1__X-SS-E-XX
  source 1..1611: mol_type = other RNA
atgagaggcctgagctccaggaagcggcgctctcacgacgtgctcaccgtccagttccttatcctggggatgttgttaatgacaggaggtgttactctggtggcccattgcattggcataacggatcgagactttatcgagggggtacacggaggcacctgggtgtcagctacactagaacaagataaatgtgtcactgtgatggcacccgacaagcctagtctcgatattagcctggagaccgttgccatcgaccgtccagcggaagtgagaaaagtctgctacaacgctgtgcttacacatgtaaagattaatgataaatgtccgtccaccggtgaggcccacctggcagaagagaacgagggggacaatgcctgcaagaggacttattctgatcggggatggggcaacggctgtgggttgttcggaaagggttcgatcgttgcttgcgcaaaatttacatgtgccaagtcaatgagcctcttcgaagtggaccagaccaaaatacagtacgtcatccgcgctcagctgcatgtgggcgccaagcaagagaattggaacacggatattaaaactctgaagtttgacgcgctcagtgggtcccaggaagtggagttcatcggatatggcaaggcaaccttagagtgccaggtccagacagccgttgattttggtaattcttacattgctgaaatggagactgaaagctggatcgtggacagacaatgggcccaggacctgacccttccctggcagtccgggtcaggaggcgtatggagggagatgcaccacttggtggagttcgaacctccacatgcagctacaatacgggtcctggccctaggcaaccaggaggggagtctcaaaaccgcgctgacgggagccatgcgcgtgactaaggatacaaatgacaacaatctttataaactgcacggtggccatgttagctgtcgagtgaagttgtctgcactcaccctgaaagggacttcctacaagatttgcacagataaaatgtttttcgtcaagaaccccaccgacacgggacacggcaccgtggtaatgcaagttaaggtgtcaaaaggtgctccttgtagaatcccagtcattgtggccgatgacttaacagctgccatcaataaggggatcctggtcactgtgaaccccattgcaagcaccaatgatgacgaagttctcatagaggtgaaccctccatttggcgatagttatatcattgtaggaaggggcgactctcggcttacataccagtggcacaaagaagggtccagcatcggaaagctgttcactcagaccatgaaaggtgtcgagcgtttggccgtgatgggcgatacagcttgggacttttcgtctgcagggggattcttcacctccgttggcaagggtatacatactgtgtttgggtcagcgttccaaggcctatttggaggcctgaactggattacgaaggtcatcatgggggccgtgctcatctgggtaggaattaatacacgcaacatgaccatgagtatgagcatgatcctggtgggtgttattatgatgttcctttccctgggcgtcggggctgaccagggatgcgccataaattttggcaaa

SEQ ID NO: 219 - RNA, 2025 nt, synthetic construct
  misc_feature 1..2025: note = derived and/or modified CDS sequence (opt3) from YFV 17D__NC_002031.1__SS-prME
  source 1..2025: mol_type = other RNA
gacgtgctgaccgtccagttcctcatccttggcatgctgttgatgacagggggagttactttagtgagaaagaacaggtggctgctactcaatgtaacgagcgaggatctgggtaaaaccttttccgtgggcacagggaactgcactaccaatattcttgaagccaagtactggtgtcccgactctatggagtataactgccctaatctgtcaccacgggaggaaccggatgacatagattgttggtgctacggagtcgaaaacgtgcgcgttgcttatggcaaatgtgacagtgcaggtcgaagccgtagatccaggcgggccatcgatttgcccacacacgagaatcatgggctcaagacccgccaagagaaatggatgactggaagaatgggcgaaaggcagctgcagaagattgagcggtggttcgtgcgcaaccctttcttcgcggtcacagctctgaccatcgcctacctcgtgggctctaatatgacgcagcgagtagttattgcattactggtgcttgccgtcgggccagcttattcggcacactgcatcggaataactgacagagattttatcgaaggtgtgcatggcgggacctgggtgtcagccacattggagcaagacaagtgtgtcactgttatggctcccgataaacctagcctggacattagtctagagaccgtggccatcgataggccagcggaagtacggaaggtgtgctacaacgcagtcctcacacacgtgaaaattaatgacaagtgtccctccaccggagaggcccatctggctgaagagaacgaaggcgacaatgcctgcaaacgtacgtattctgatcgcggttgggggaacggatgtggccttttcggcaaggggagcatcgttgcatgcgctaagtttacttgcgccaaatccatgtcactgttcgaggtggaccagacaaagatacagtacgtcattagagcgcagttgcacgtgggagccaaacaagagaattggaacaccgatatcaagactctcaaatttgacgcactgagtggtagccaggaagtagagttcattggctacgggaaggctacattagaatgtcaggttcagaccgccgtggattttggaaactcttatatcgctgagatggaaacggagtcctggatcgtcgacaggcaatgggcccaggatctgaccctcccttggcagtcaggcagcggtggggtgtggcgggagatgcaccatcttgtcgaatttgagccaccgcacgcagccacaattcgagtgctggctttgggcaatcaagaaggaagtctaaaaactgcgctgaccggcgcaatgcgcgttacaaaggacactaacgataataacctctacaagctgcatgggggacacgtgtcttgcagagtaaaactttccgccctgaccttgaagggtacaagctataaaatatgtaccgacaagatgtttttcgtcaaaaatcccactgatacgggccacgggacagtggttatgcaagtgaaggtctcgaagggagctccttgcaggatcccagtgattgtagccgacgacctcaccgcagccatcaacaaaggcatactggtgactgttaatcccattgcttctaccaacgatgacgaggtcttaatcgaagtgaatcctccattcggtgattcctacatcattgtggggcggggcgactcacgcctgacatatcagtggcataaggagggaagtagcatcggcaaactatttacccagactatgaagggggtcgagagactcgccgttatgggagatacagcatgggacttctcctctgcgggtggctttttcacgagcgtggggaaaggcattcacaccgtgtttggatcagctttccagggtctgtttgggggccttaactggataactaaggtaatcatgggagccgtcttgatttgggtgggcatcaatacaaggaacatgaccatgagtatgtccatgatcctggttggggtgattatgatgttcctcagcctgggagtcggcgca

SEQ ID NO: 220 - RNA, 3081 nt, synthetic construct
  misc_feature 1..3081: note = derived and/or modified CDS sequence (opt3) from YFV 17D__NC_002031.1__SS-prME-NS1
  source 1..3081: mol_type = other RNA
gacgtgctgaccgtccagttcctcatccttggcatgctgttgatgacagggggagttactttagtgagaaagaacaggtggctgctactcaatgtaacgagcgaggatctgggtaaaaccttttccgtgggcacagggaactgcactaccaatattcttgaagccaagtactggtgtcccgactctatggagtataactgccctaatctgtcaccacgggaagaaccggatgacatagattgttggtgctacggagtcgaaaacgtgcgcgttgcttatggcaaatgtgacagtgcaggtcgaagccgtagatccaggcgggccatcgatttgcccacacacgagaatcatgggctcaagacccgccaagagaaatggatgactggaagaatgggcgaaaggcagctgcagaagattgagcggtggttcgtgcgcaaccctttcttcgcggtcacagctctgaccatcgcctacctcgtgggctctaatatgacgcagcgagtagttattgcattactggtgcttgccgtcgggccagcttattcggcacactgcatcggaataactgacagagattttatcgaaggtgtgcatggcgggacctgggtgtcagccacattggagcaagacaagtgtgtcactgttatggctcccgataaacctagcctggacattagtctagagaccgtggccatcgataggccagcggaagtacggaaggtgtgctacaacgcagtcctcacacacgtgaaaattaatgacaagtgtccctccaccggagaggcccatctggctgaagagaacgaaggcgacaatgcctgcaaacgtacgtattctgatcgcggttgggggaacggatgtggccttttcggcaaggggagcatcgttgcatgcgctaagtttacttgcgccaaatccatgtcactgttcgaggtggaccagacaaagatacagtacgtcattagagcgcagttgcacgtgggagccaaacaagagaattggaacaccgatatcaagactctcaaatttgacgcactgagtggtagccaggaagtagagttcattggctacgggaaggctacattagaatgtcaggttcagaccgccgtggattttggaaactcttatatcgctgagatggaaacggagtcctggatcgtcgacaggcaatgggcccaggatctgaccctcccttggcagtcaggcagcggtggggtgtggcgggagatgcaccatcttgtcgaatttgagccaccgcacgcagccacaattcgagtgctggctttgggcaatcaagaaggaagtctaaaaactgcgctgaccggcgcaatgcgcgttacaaaggacactaacgataataacctctacaagctgcatgggggacacgtgtcttgcagagtaaaactttccgccctgaccttgaagggtacaagctataaaatatgtaccgacaagatgtttttcgtcaaaaatcccactgatacgggccacgggacagtggttatgcaagtgaaggtctcgaagggagctccttgcaggatcccagtgattgtagccgacgacctcaccgcagccatcaacaaaggcatactggtgactgttaatcccattgcttctaccaacgatgacgaggtcttaatcgaagtgaatcctccattcggtgattcctacatcattgtggggcggggcgactcacgcctgacatatcagtggcataaggagggaagtagcatcggcaaactatttacccagactatgaagggggtcgagagactcgccgttatgggagatacagcatgggacttctcctctgcgggtggctttttcacgagcgtggggaaaggcattcacaccgtgtttggatcagctttccagggtctgtttgggggccttaactggataactaaggtaatcatgggagccgtcttgatttgggtgggcatcaatacaaggaacatgaccatgagtatgtccatgatcctggttggggtgattatgatgttcctcagcctgggagtcggcgcagatcagggttgtgccataaattttgggaagcgtgaacttaaatgcggagacggcatcttcatttttcgggattctgacgattggctgaacaagtactcatattaccccgaggacccggtgaaattggctagtatcgttaaggccagcttcgaagagggtaaatgtggcctcaattccgtggattctctggagcatgaaatgtggcgatcgagagcagacgagattaacgctatctttgaagagaacgaagtagacataagcgtcgtggtgcaggatcctaagaatgtctaccagagggggacacaccccttctcccgcatccgggacggattacaatatggctggaagacttgggggaaaaacctggttttctcaccaggaagaaagaatggcagttttattatcgatggtaaatctaggaaggagtgccctttcagcaaccgcgtgtggaactcctttcagattgaggagttcgggaccggagtatttacgacccgagtgtacatggacgccgtcttcgagtatacaatcgattgtgacggctcaatactaggtgcggccgtgaatggcaaaaagagcgctcatgggtctcccactttttggatgggatcccacgaagttaatggcacctggatgattcacacactcgaggcactggattacaaagaatgcgagtggccacttactcataccatcgggacgagtgtggaggaaagcgagatgttcatgccccggtctattggaggccctgtctcctcacacaaccatatcccaggttataaggtgcagacaaatgggccgtggatgcaggttcccttggaagtgaagcgtgaggcctgtcctggaaccagtgtcataatcgacggcaactgcgatggtagaggcaaaagcactaggtcgacaaccgactccgggaaggtaattccagaatggtgctgtcgctcttgcactatgccccctgtgagctttcacggatcagatggctgttggtacccaatggagatccggcccagaaaaacccacgagagtcatctggttaggtcctgggtgacagct

SEQ ID NO: 221 - RNA, 273 nt, synthetic construct
  misc_feature 1..273: note = derived and/or modified CDS sequence (opt3) from YFV 17D__NC_002031.1__C (without X-SS)
  source 1..273: mol_type = other RNA
atgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctg

SEQ ID NO: 222 - RNA, 1026 nt, synthetic construct
  misc_feature 1..1026: note = derived and/or modified CDS sequence (opt3) from YFV 17D__NC_002031.1__NS1 (without XX)
  source 1..1026: mol_type = other RNA
agagagctgaagtgcggcgacgggatcttcatttttagggatagcgacgattggctcaacaaatactcctattaccccgaagaccctgtgaaacttgcctctatagtcaaggcttcattcgaggaaggaaagtgtggtctgaatagtgttgatagcttggagcacgaaatgtggcggtcccgcgcagacgagatcaacgccatttttgaggaaaatgaggtggatatctctgtagtggtccaggacccgaaaaacgtgtatcaacgaggcacccatccattctcgcgtattagagatgggttacagtacggatggaagacatggggcaagaatctggtgttttcacccggtaggaaaaacgggagcttcatcatagacggaaagagtcggaaagaatgccctttttccaatcgcgtttggaactctttccagatcgaggagtttggcactggcgtcttcacgaccagagtgtatatggatgcggtatttgaatacacaattgactgtgatgggagcatcctaggagctgccgttaatggtaagaaatccgcacacggctcaccaactttctggatggggagtcatgaggtgaacggaacctggatgattcacacactcgaagccctggactataaggagtgcgaatggccccttacccatactatcggcacaagcgtcgaggagtctgaaatgtttatgcctaggtccataggtgggccagtgtcaagccacaatcacattcccggatacaaggtgcagaccaacggcccttggatgcaagtcccactggaggttaaacgggaggcttgtccgggcacgagtgtgatcattgacgggaattgcgatggacgcggtaagtctactcgatccaccacagacagcggcaaagtaatccccgaatggtgttgcagatcgtgtactatgcctccagtgtctttccatgggtccgatggatgctggtaccccatggaaatcaggcctcggaagacccacgagtcacatttggtccgtagttgggtgacagca

SEQ ID NO: 223 - RNA, 10233 nt, synthetic construct
  misc_feature 1..10233: note = derived and/or modified CDS sequence (opt4) from YFV 17D__NC_002031.1__polyprotein
  source 1..10233: mol_type = other RNA
atgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgccggcgagatccacgccgtgcccttcggcctggtgagcatgatgatcgccatggaggtggtgctgagaaagagacagggccccaagcagatgctggtgggcggcgtggtgctgctgggcgccatgctggtgggccaggtgaccctgctggacctgctgaagctgaccgtggccgtgggcctgcacttccacgagatgaacaacggcggcgacgccatgtacatggccctgatcgccgccttcagcatcagacccggcctgctgatcggcttcggcctgagaaccctgtggagccccagagagagactggtgctgaccctgggcgccgccatggtggagatcgccctgggcggcgtgatgggcggcctgtggaagtacctgaacgccgtgagcctgtgcatcctgaccatcaacgccgtggccagcagaaaggccagcaacaccatcctgcccctgatggccctgctgacccccgtgaccatggccgaggtgagactggccgccatgttcttctgcgccgtggtgatcatcggcgtgctgcaccagaacttcaaggacaccagcatgcagaagaccatccccctggtggccctgaccctgaccagctacctgggcctgacccagcccttcctgggcctgtgcgccttcctggccaccagaatcttcggcagaagaagcatccccgtgaacgaggccctggccgccgccggcctggtgggcgtgctggccggcctggccttccaggagatggagaacttcctgggccccatcgccgtgggcggcctgctgatgatgctggtgagcgtggccggcagagtggacggcctggagctgaagaagctgggcgaggtgagctgggaggaggaggccgagatcagcggcagcagcgccagatacgacgtggccctgagcgagcagggcgagttcaagctgctgagcgaggagaaggtgccctgggaccaggtggtgatgaccagcctggccctggtgggcgccgccctgcaccccttcgccctgctgctggtgctggccggctggctgttccacgtgagaggcgccagaagaagcggcgacgtgctgtgggacatccccacccccaagatcatcgaggagtgcgagcacctggaggacggcatctacggcatcttccagagcaccttcctgggcgccagccagagaggcgtgggcgtggcccagggcggcgtgttccacaccatgtggcacgtgaccagaggcgccttcctggtgagaaacggcaagaagctgatccccagctgggccagcgtgaaggaggacctggtggcctacggcggcagctggaagctggagggcagatgggacggcgaggaggaggtgcagctgatcgccgccgtgcccggcaagaacgtggtgaacgtgcagaccaagcccagcctgttcaaggtgagaaacggcggcgagatcggcgccgtggccctggactaccccagcggcaccagcggcagccccatcgtgaacagaaacggcgaggtgatcggcctgtacggcaacggcatcctggtgggcgacaacagcttcgtgagcgccatcagccagaccgaggtgaaggaggagggcaaggaggagctgcaggagatccccaccatgctgaagaagggcatgaccaccgtgctggacttccaccccggcgccggcaagaccagaagattcctgccccagatcctggccgagtgcgccagaagaagactgagaaccctggtgctggcccccaccagagtggtgctgagcgagatgaaggaggccttccacggcctggacgtgaagttccacacccaggccttcagcgcccacggcagcggcagagaggtgatcgacgccatgtgccacgccaccctgacctacagaatgctggagcccaccagagtggtgaactgggaggtgatcatcatggacgaggcccacttcctggaccccgccagcatcgccgccagaggctgggccgcccacagagccagagccaacgagagcgccaccatcctgatgaccgccaccccccccggcaccagcgacgagttcccccacagcaacggcgagatcgaggacgtgcagaccgacatccccagcgagccctggaacaccggccacgactggatcctggccgacaagagacccaccgcctggttcctgcccagcatcagagccgccaacgtgatggccgccagcctgagaaaggccggcaagagcgtggtggtgctgaacagaaagaccttcgagagagagtaccccaccatcaagcagaagaagcccgacttcatcctggccaccgacatcgccgagatgggcgccaacctgtgcgtggagagagtgctggactgcagaaccgccttcaagcccgtgctggtggacgagggcagaaaggtggccatcaagggccccctgagaatcagcgccagcagcgccgcccagagaagaggcagaatcggcagaaaccccaacagagacggcgacagctactactacagcgagcccaccagcgagaacaacgcccaccacgtgtgctggctggaggccagcatgctgctggacaacatggaggtgagaggcggcatggtggcccccctgtacggcgtggagggcaccaagacccccgtgagccccggcgagatgagactgagagacgaccagagaaaggtgttcagagagctggtgagaaactgcgacctgcccgtgtggctgagctggcaggtggccaaggccggcctgaagaccaacgacagaaagtggtgcttcgagggccccgaggagcacgagatcctgaacgacagcggcgagaccgtgaagtgcagagcccccggcggcgccaagaagcccctgagacccagatggtgcgacgagagagtgagcagcgaccagagcgccctgagcgagttcatcaagttcgccgagggcagaagaggcgccgccgaggtgctggtggtgctgagcgagctgcccgacttcctggccaagaagggcggcgaggccatggacaccatcagcgtgttcctgcacagcgaggagggcagcagagcctacagaaacgccctgagcatgatgcccgaggccatgaccatcgtgatgctgttcatcctggccggcctgctgaccagcggcatggtgatcttcttcatgagccccaagggcatcagcagaatgagcatggccatgggcaccatggccggctgcggctacctgatgttcctgggcggcgtgaagcccacccacatcagctacgtgatgctgatcttcttcgtgctgatggtggtggtgatccccgagcccggccagcagagaagcatccaggacaaccaggtggcctacctgatcatcggcatcctgaccctggtgagcgccgtggccgccaacgagctgggcatgctggagaagaccaaggaggacctgttcggcaagaagaacctgatccccagcagcgccagcccctggagctggcccgacctggacctgaagcccggcgccgcctggaccgtgtacgtgggcatcgtgaccatgctgagccccatgctgcaccactggatcaaggtggagtacggcaacctgagcctgagcggcatcgcccagagcgccagcgtgctgagcttcatggacaagggcatccccttcatgaagatgaacatcagcgtgatcatgctgctggtgagcggctggaacagcatcaccgtgatgcccctgctgtgcggcatcggctgcgccatgctgcactggagcctgatcctgcccggcatcaaggcccagcagagcaagctggcccagagaagagtgttccacggcgtggccgagaaccccgtggtggacggcaaccccaccgtggacatcgaggaggcccccgagatgcccgccctgtacgagaagaagctggccctgtacctgctgctggccctgagcctggccagcgtggccatgtgcagaacccccttcagcctggccgagggcatcgtgctggccagcgccgccctgggccccctgatcgagggcaacaccagcctgctgtggaacggccccatggccgtgagcatgaccggcgtgatgagaggcaaccactacgccttcgtgggcgtgatgtacaacctgtggaagatgaagaccggcagaagaggcagcgccaacggcaagaccctgggcgaggtgtggaagagagagctgaacctgctggacaagagacagttcgagctgtacaagagaaccgacatcgtggaggtggacagagacaccgccagaagacacctggccgagggcaaggtggacaccggcgtggccgtgagcagaggcaccgccaagctgagatggttccacgagagaggctacgtgaagctggagggcagagtgatcgacctgggctgcggcagaggcggctggtgctactacgccgccgcccagaaggaggtgagcggcgtgaagggcttcaccctgggcagagacggccacgagaagcccatgaacgtgcagagcctgggctggaacatcatcaccttcaaggacaagaccgacatccacagactggagcccgtgaagtgcgacaccctgctgtgcgacatcggcgagagcagcagcagcagcgtgaccgagggcgagagaaccgtgagagtgctggacaccgtggagaagtggctggcctgcggcgtggacaacttctgcgtgaaggtgctggccccctacatgcccgacgtgctggagaagctggagctgctgcagagaagattcggcggcaccgtgatcagaaaccccctgagcagaaacagcacccacgagatgtactacgtgagcggcgccagaagcaacgtgaccttcaccgtgaaccagaccagcagactgctgatgagaagaatgagaagacccaccggcaaggtgaccctggaggccgacgtgatcctgcccatcggcaccagaagcgtggagaccgacaagggccccctggacaaggaggccatcgaggagagagtggagagaatcaagagcgagtacatgaccagctggttctacgacaacgacaacccctacagaacctggcactactgcggcagctacgtgaccaagaccagcggcagcgccgccagcatggtgaacggcgtgatcaagatcctgacctacccctgggacagaatcgaggaggtgaccagaatggccatgaccgacaccacccccttcggccagcagagagtgttcaaggagaaggtggacaccagagccaaggacccccccgccggcaccagaaagatcatgaaggtggtgaacagatggctgttcagacacctggccagagagaagaaccccagactgtgcaccaaggaggagttcatcgccaaggtgagaagccacgccgccatcggcgcctacctggaggagcaggagcagtggaagaccgccaacgaggccgtgcaggaccccaagttctgggagctggtggacgaggagagaaagctgcaccagcagggcagatgcagaacctgcgtgtacaacatgatgggcaagagagagaagaagctgagcgagttcggcaaggccaagggcagcagagccatctggtacatgtggctgggcgccagatacctggagttcgaggccctgggcttcctgaacgaggaccactgggccagcagagagaacagcggcggcggcgtggagggcatcggcctgcagtacctgggctacgtgatcagagacctggccgccatggacggcggcggcttctacgccgacgacaccgccggctgggacaccagaatcaccgaggccgacctggacgacgagcaggagatcctgaactacatgagcccccaccacaagaagctggcccaggccgtgatggagatgacctacaagaacaaggtggtgaaggtgctgagacccgcccccggcggcaaggcctacatggacgtgatcagcagaagagaccagagaggcagcggccaggtggtgacctacgccctgaacaccatcaccaacctgaaggtgcagctgatcagaatggccgaggccgagatggtgatccaccaccagcacgtgcaggactgcgacgagagcgtgctgaccagactggaggcctggctgaccgagcacggctgcgacagactgaagagaatggccgtgagcggcgacgactgcgtggtgagacccatcgacgacagattcggcctggccctgagccacctgaacgccatgagcaaggtgagaaaggacatcagcgagtggcagcccagcaagggctggaacgactgggagaacgtgcccttctgcagccaccacttccacgagctgcagctgaaggacggcagaagaatcgtggtgccctgcagagagcaggacgagctgatcggcagaggcagagtgagccccggcaacggctggatgatcaaggagaccgcctgcctgagcaaggcctacgccaacatgtggagcctgatgtacttccacaagagagacatgagactgctgagcctggccgtgagcagcgccgtgcccaccagctgggtgccccagggcagaaccacctggagcatccacggcaagggcgagtggatgaccaccgaggacatgctggaggtgtggaacagagtgtggatcaccaacaacccccacatgcaggacaagaccatggtgaagaagtggagagacgtgccctacctgaccaagagacaggacaagctgtgcggcagcctgatcggcatgaccaacagagccacctgggccagccacatccacctggtgatccacagaatcagaaccctgatcggccaggagaagtacaccgactacctgaccgtgatggacagatacagcgtggacgccgacctgcagctgggcgagctgatc

SEQ ID NO: 224 - RNA, 303 nt, synthetic construct
  misc_feature 1..303: note = derived and/or modified CDS sequence (opt4) from YFV 17D__NC_002031.1__C
  source 1..303: mol_type = other RNA
atgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaaga

SEQ ID NO: 225 - RNA, 363 nt, synthetic construct
  misc_feature 1..363: note = derived and/or modified CDS sequence (opt4) from YFV 17D__NC_002031.1__C-ER anchor
  source 1..363: mol_type = other RNA
atgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggc

SEQ ID NO: 226 - RNA, 267 nt, synthetic construct
  misc_feature 1..267: note = derived and/or modified CDS sequence (opt4) from YFV 17D__NC_002031.1__pr
  source 1..267: mol_type = other RNA
gtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaaga

SEQ ID NO: 227 - RNA, 225 nt, synthetic construct
  misc_feature 1..225: note = derived and/or modified CDS sequence (opt4) from YFV 17D__NC_002031.1__M
  source 1..225: mol_type = other RNA
gccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagc

SEQ ID NO: 228 - RNA, 492 nt, synthetic construct
  misc_feature 1..492: note = derived and/or modified CDS sequence (opt4) from YFV 17D__NC_002031.1__prM
  source 1..492: mol_type = other RNA
gtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagc

SEQ ID NO: 229 - RNA, 1479 nt, synthetic construct
  misc_feature 1..1479: note = derived and/or modified CDS sequence (opt4) from YFV 17D__NC_002031.1__E
  source 1..1479: mol_type = other RNA
gcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 230 - RNA, 1971 nt, synthetic construct
  misc_feature 1..1971: note = derived and/or modified CDS sequence (opt4) from YFV 17D__NC_002031.1__prME
  source 1..1971: mol_type = other RNA
gtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 231 - RNA, 2031 nt, synthetic construct
  misc_feature 1..2031: note = derived and/or modified CDS sequence (opt4) from YFV 17D__NC_002031.1__ER anchor-prME
  source 1..2031: mol_type = other RNA
agccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 232 - RNA, 1056 nt, synthetic construct
  misc_feature 1..1056: note = derived and/or modified CDS sequence (opt4) from YFV 17D__NC_002031.1__NS1
  source 1..1056: mol_type = other RNA
gaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcc

SEQ ID NO: 233 - RNA, 672 nt, synthetic construct
  misc_feature 1..672: note = derived and/or modified CDS sequence (opt4) from YFV 17D__NC_002031.1__NS2A
  source 1..672: mol_type = other RNA
ggcgagatccacgccgtgcccttcggcctggtgagcatgatgatcgccatggaggtggtgctgagaaagagacagggccccaagcagatgctggtgggcggcgtggtgctgctgggcgccatgctggtgggccaggtgaccctgctggacctgctgaagctgaccgtggccgtgggcctgcacttccacgagatgaacaacggcggcgacgccatgtacatggccctgatcgccgccttcagcatcagacccggcctgctgatcggcttcggcctgagaaccctgtggagccccagagagagactggtgctgaccctgggcgccgccatggtggagatcgccctgggcggcgtgatgggcggcctgtggaagtacctgaacgccgtgagcctgtgcatcctgaccatcaacgccgtggccagcagaaaggccagcaacaccatcctgcccctgatggccctgctgacccccgtgaccatggccgaggtgagactggccgccatgttcttctgcgccgtggtgatcatcggcgtgctgcaccagaacttcaaggacaccagcatgcagaagaccatccccctggtggccctgaccctgaccagctacctgggcctgacccagcccttcctgggcctgtgcgccttcctggccaccagaatcttcggcagaaga

SEQ ID NO: 234 - RNA, 390 nt, synthetic construct
  misc_feature 1..390: note = derived and/or modified CDS sequence (opt4) from YFV 17D__NC_002031.1__NS2B
  source 1..390: mol_type = other RNA
agcatccccgtgaacgaggccctggccgccgccggcctggtgggcgtgctggccggcctggccttccaggagatggagaacttcctgggccccatcgccgtgggcggcctgctgatgatgctggtgagcgtggccggcagagtggacggcctggagctgaagaagctgggcgaggtgagctgggaggaggaggccgagatcagcggcagcagcgccagatacgacgtggccctgagcgagcagggcgagttcaagctgctgagcgaggagaaggtgccctgggaccaggtggtgatgaccagcctggccctggtgggcgccgccctgcaccccttcgccctgctgctggtgctggccggctggctgttccacgtgagaggcgccagaaga

SEQ ID NO: 235 - RNA, 1869 nt, synthetic construct
  misc_feature 1..1869: note = derived and/or modified CDS sequence (opt4) from YFV 17D__NC_002031.1__NS3
  source 1..1869: mol_type = other RNA
agcggcgacgtgctgtgggacatccccacccccaagatcatcgaggagtgcgagcacctggaggacggcatctacggcatcttccagagcaccttcctgggcgccagccagagaggcgtgggcgtggcccagggcggcgtgttccacaccatgtggcacgtgaccagaggcgccttcctggtgagaaacggcaagaagctgatccccagctgggccagcgtgaaggaggacctggtggcctacggcggcagctggaagctggagggcagatgggacggcgaggaggaggtgcagctgatcgccgccgtgcccggcaagaacgtggtgaacgtgcagaccaagcccagcctgttcaaggtgagaaacggcggcgagatcggcgccgtggccctggactaccccagcggcaccagcggcagccccatcgtgaacagaaacggcgaggtgatcggcctgtacggcaacggcatcctggtgggcgacaacagcttcgtgagcgccatcagccagaccgaggtgaaggaggagggcaaggaggagctgcaggagatccccaccatgctgaagaagggcatgaccaccgtgctggacttccaccccggcgccggcaagaccagaagattcctgccccagatcctggccgagtgcgccagaagaagactgagaaccctggtgctggcccccaccagagtggtgctgagcgagatgaaggaggccttccacggcctggacgtgaagttccacacccaggccttcagcgcccacggcagcggcagagaggtgatcgacgccatgtgccacgccaccctgacctacagaatgctggagcccaccagagtggtgaactgggaggtgatcatcatggacgaggcccacttcctggaccccgccagcatcgccgccagaggctgggccgcccacagagccagagccaacgagagcgccaccatcctgatgaccgccaccccccccggcaccagcgacgagttcccccacagcaacggcgagatcgaggacgtgcagaccgacatccccagcgagccctggaacaccggccacgactggatcctggccgacaagagacccaccgcctggttcctgcccagcatcagagccgccaacgtgatggccgccagcctgagaaaggccggcaagagcgtggtggtgctgaacagaaagaccttcgagagagagtaccccaccatcaagcagaagaagcccgacttcatcctggccaccgacatcgccgagatgggcgccaacctgtgcgtggagagagtgctggactgcagaaccgccttcaagcccgtgctggtggacgagggcagaaaggtggccatcaagggccccctgagaatcagcgccagcagcgccgcccagagaagaggcagaatcggcagaaaccccaacagagacggcgacagctactactacagcgagcccaccagcgagaacaacgcccaccacgtgtgctggctggaggccagcatgctgctggacaacatggaggtgagaggcggcatggtggcccccctgtacggcgtggagggcaccaagacccccgtgagccccggcgagatgagactgagagacgaccagagaaaggtgttcagagagctggtgagaaactgcgacctgcccgtgtggctgagctggcaggtggccaaggccggcctgaagaccaacgacagaaagtggtgcttcgagggccccgaggagcacgagatcctgaacgacagcggcgagaccgtgaagtgcagagcccccggcggcgccaagaagcccctgagacccagatggtgcgacgagagagtgagcagcgaccagagcgccctgagcgagttcatcaagttcgccgagggcagaaga

SEQ ID NO: 236 - RNA, 447 nt, synthetic construct
  misc_feature 1..447: note = derived and/or modified CDS sequence (opt4) from YFV 17D__NC_002031.1__NS4A-P2K
  source 1..447: mol_type = other RNA
ggcgccgccgaggtgctggtggtgctgagcgagctgcccgacttcctggccaagaagggcggcgaggccatggacaccatcagcgtgttcctgcacagcgaggagggcagcagagcctacagaaacgccctgagcatgatgcccgaggccatgaccatcgtgatgctgttcatcctggccggcctgctgaccagcggcatggtgatcttcttcatgagccccaagggcatcagcagaatgagcatggccatgggcaccatggccggctgcggctacctgatgttcctgggcggcgtgaagcccacccacatcagctacgtgatgctgatcttcttcgtgctgatggtggtggtgatccccgagcccggccagcagagaagcatccaggacaaccaggtggcctacctgatcatcggcatcctgaccctggtgagcgccgtggccgcc

SEQ ID NO: 237 - RNA, 750 nt, synthetic construct
  misc_feature 1..750: note = derived and/or modified CDS sequence (opt4) from YFV 17D__NC_002031.1__NS4B
  source 1..750: mol_type = other RNA
aacgagctgggcatgctggagaagaccaaggaggacctgttcggcaagaagaacctgatccccagcagcgccagcccctggagctggcccgacctggacctgaagcccggcgccgcctggaccgtgtacgtgggcatcgtgaccatgctgagccccatgctgcaccactggatcaaggtggagtacggcaacctgagcctgagcggcatcgcccagagcgccagcgtgctgagcttcatggacaagggcatccccttcatgaagatgaacatcagcgtgatcatgctgctggtgagcggctggaacagcatcaccgtgatgcccctgctgtgcggcatcggctgcgccatgctgcactggagcctgatcctgcccggcatcaaggcccagcagagcaagctggcccagagaagagtgttccacggcgtggccgagaaccccgtggtggacggcaaccccaccgtggacatcgaggaggcccccgagatgcccgccctgtacgagaagaagctggccctgtacctgctgctggccctgagcctggccagcgtggccatgtgcagaacccccttcagcctggccgagggcatcgtgctggccagcgccgccctgggccccctgatcgagggcaacaccagcctgctgtggaacggccccatggccgtgagcatgaccggcgtgatgagaggcaaccactacgccttcgtgggcgtgatgtacaacctgtggaagatgaagaccggcagaaga

SEQ ID NO: 238 - RNA, 2715 nt, synthetic construct
  misc_feature 1..2715: note = derived and/or modified CDS sequence (opt4) from YFV 17D__NC_002031.1__NS5
  source 1..2715: mol_type = other RNA
ggcagcgccaacggcaagaccctgggcgaggtgtggaagagagagctgaacctgctggacaagagacagttcgagctgtacaagagaaccgacatcgtggaggtggacagagacaccgccagaagacacctggccgagggcaaggtggacaccggcgtggccgtgagcagaggcaccgccaagctgagatggttccacgagagaggctacgtgaagctggagggcagagtgatcgacctgggctgcggcagaggcggctggtgctactacgccgccgcccagaaggaggtgagcggcgtgaagggcttcaccctgggcagagacggccacgagaagcccatgaacgtgcagagcctgggctggaacatcatcaccttcaaggacaagaccgacatccacagactggagcccgtgaagtgcgacaccctgctgtgcgacatcggcgagagcagcagcagcagcgtgaccgagggcgagagaaccgtgagagtgctggacaccgtggagaagtggctggcctgcggcgtggacaacttctgcgtgaaggtgctggccccctacatgcccgacgtgctggagaagctggagctgctgcagagaagattcggcggcaccgtgatcagaaaccccctgagcagaaacagcacccacgagatgtactacgtgagcggcgccagaagcaacgtgaccttcaccgtgaaccagaccagcagactgctgatgagaagaatgagaagacccaccggcaaggtgaccctggaggccgacgtgatcctgcccatcggcaccagaagcgtggagaccgacaagggccccctggacaaggaggccatcgaggagagagtggagagaatcaagagcgagtacatgaccagctggttctacgacaacgacaacccctacagaacctggcactactgcggcagctacgtgaccaagaccagcggcagcgccgccagcatggtgaacggcgtgatcaagatcctgacctacccctgggacagaatcgaggaggtgaccagaatggccatgaccgacaccacccccttcggccagcagagagtgttcaaggagaaggtggacaccagagccaaggacccccccgccggcaccagaaagatcatgaaggtggtgaacagatggctgttcagacacctggccagagagaagaaccccagactgtgcaccaaggaggagttcatcgccaaggtgagaagccacgccgccatcggcgcctacctggaggagcaggagcagtggaagaccgccaacgaggccgtgcaggaccccaagttctgggagctggtggacgaggagagaaagctgcaccagcagggcagatgcagaacctgcgtgtacaacatgatgggcaagagagagaagaagctgagcgagttcggcaaggccaagggcagcagagccatctggtacatgtggctgggcgccagatacctggagttcgaggccctgggcttcctgaacgaggaccactgggccagcagagagaacagcggcggcggcgtggagggcatcggcctgcagtacctgggctacgtgatcagagacctggccgccatggacggcggcggcttctacgccgacgacaccgccggctgggacaccagaatcaccgaggccgacctggacgacgagcaggagatcctgaactacatgagcccccaccacaagaagctggcccaggccgtgatggagatgacctacaagaacaaggtggtgaaggtgctgagacccgcccccggcggcaaggcctacatggacgtgatcagcagaagagaccagagaggcagcggccaggtggtgacctacgccctgaacaccatcaccaacctgaaggtgcagctgatcagaatggccgaggccgagatggtgatccaccaccagcacgtgcaggactgcgacgagagcgtgctgaccagactggaggcctggctgaccgagcacggctgcgacagactgaagagaatggccgtgagcggcgacgactgcgtggtgagacccatcgacgacagattcggcctggccctgagccacctgaacgccatgagcaaggtgagaaaggacatcagcgagtggcagcccagcaagggctggaacgactgggagaacgtgcccttctgcagccaccacttccacgagctgcagctgaaggacggcagaagaatcgtggtgccctgcagagagcaggacgagctgatcggcagaggcagagtgagccccggcaacggctggatgatcaaggagaccgcctgcctgagcaaggcctacgccaacatgtggagcctgatgtacttccacaagagagacatgagactgctgagcctggccgtgagcagcgccgtgcccaccagctgggtgccccagggcagaaccacctggagcatccacggcaagggcgagtggatgaccaccgaggacatgctggaggtgtggaacagagtgtggatcaccaacaacccccacatgcaggacaagaccatggtgaagaagtggagagacgtgccctacctgaccaagagacaggacaagctgtgcggcagcctgatcggcatgaccaacagagccacctgggccagccacatccacctggtgatccacagaatcagaaccctgatcggccaggagaagtacaccgactacctgaccgtgatggacagatacagcgtggacgccgacctgcagctgggcgagctgatc

SEQ ID NO: 239 - RNA, 2334 nt, synthetic construct
  misc_feature 1..2334: note = derived and/or modified CDS sequence (opt4) from YFV 17D__NC_002031.1__C-prME
  source 1..2334: mol_type = other RNA
atgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 240 - RNA, 3390 nt, synthetic construct
  misc_feature 1..3390: note = derived and/or modified CDS sequence (opt4) from YFV 17D__NC_002031.1__C-prME-NS1
  source 1..3390: mol_type = other RNA
atgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcc

SEQ ID NO: 241 - RNA, 30 nt, synthetic construct
  misc_feature 1..30: note = derived and/or modified CDS sequence (opt4) from YFV 17D__NC_002031.1__X or 10aa (5'-terminus)
  source 1..30: mol_type = other RNA
atgagaggcctgagcagcagaaagagaaga

SEQ ID NO: 242 - RNA, 60 nt, synthetic construct
  misc_feature 1..60: note = derived and/or modified CDS sequence (opt4) from YFV 17D__NC_002031.1__SS or ER anchor (v1)
  source 1..60: mol_type = other RNA
agccacgacgtgctgaccgtgcagttcctgatcctgggcatgctgctgatgaccggcggc

SEQ ID NO: 243 - RNA, 54 nt, synthetic construct
  misc_feature 1..54: note = derived and/or modified CDS sequence (opt4) from YFV 17D__NC_002031.1__SS or ER anchor (v2)
  source 1..54: mol_type = other RNA
gacgtgctgaccgtgcagttcctgatcctgggcatgctgctgatgaccggcggc

SEQ ID NO: 244 - RNA, 72 nt, synthetic construct
  misc_feature 1..72: note = derived and/or modified CDS sequence (opt4) from YFV 17D__NC_002031.1__SS or ER anchor (v4)
  source 1..72: mol_type = other RNA
agccacgacgtgctgaccgtgcagttcctgatcctgggcatgctgctgatgaccggcggcgtgaccctggtg

SEQ ID NO: 245 - RNA, 90 nt, synthetic construct
  misc_feature 1..90: note = derived and/or modified CDS sequence (opt4) from YFV 17D__NC_002031.1__X-SS or 10aa (5'-terminus)-SS (v1)
  source 1..90: mol_type = other RNA
atgagaggcctgagcagcagaaagagaagaagccacgacgtgctgaccgtgcagttcctgatcctgggcatgctgctgatgaccggcggc

SEQ ID NO: 246 - RNA, 102 nt, synthetic construct
  misc_feature 1..102: note = derived and/or modified CDS sequence (opt4) from YFV 17D__NC_002031.1__X-SS or 10aa (5'-terminus)-SS (v2)
  source 1..102: mol_type = other RNA
atgagaggcctgagcagcagaaagagaagaagccacgacgtgctgaccgtgcagttcctgatcctgggcatgctgctgatgaccggcggcgtgaccctggtg

SEQ ID NO: 247 - RNA, 30 nt, synthetic construct; identical to SEQ ID NO: 117
  misc_feature 1..30: note = derived and/or modified CDS sequence (opt4) from YFV 17D__NC_002031.1__XX or 10aa (3'-terminus)
  source 1..30: mol_type = other RNA

SEQ ID NO: 248 - RNA, 2091 nt, synthetic construct
  misc_feature 1..2091: note = derived and/or modified CDS sequence (opt4) from YFV 17D__NC_002031.1__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 249 - RNA, 1581 nt, synthetic construct
  misc_feature 1..1581: note = derived and/or modified CDS sequence (opt4) from YFV 17D__NC_002031.1__X-SS-E
  source 1..1581: mol_type = other RNA
atgagaggcctgagcagcagaaagagaagaagccacgacgtgctgaccgtgcagttcctgatcctgggcatgctgctgatgaccggcggcgtgaccctggtggcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 250 - RNA, 1611 nt, synthetic construct
  misc_feature 1..1611: note = derived and/or modified CDS sequence (opt4) from YFV 17D__NC_002031.1__X-SS-E-XX
  source 1..1611: mol_type = other RNA
atgagaggcctgagcagcagaaagagaagaagccacgacgtgctgaccgtgcagttcctgatcctgggcatgctgctgatgaccggcggcgtgaccctggtggcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 251 - RNA, 2025 nt, synthetic construct
  misc_feature 1..2025: note = derived and/or modified CDS sequence (opt4) from YFV 17D__NC_002031.1__SS-prME
  source 1..2025: mol_type = other RNA
gacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 252 - RNA, 3081 nt, synthetic construct
  misc_feature 1..3081: note = derived and/or modified CDS sequence (opt4) from YFV 17D__NC_002031.1__SS-prME-NS1
  source 1..3081: mol_type = other RNA
gacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcc

SEQ ID NO: 253 - RNA, 273 nt, synthetic construct
  misc_feature 1..273: note = derived and/or modified CDS sequence (opt4) from YFV 17D__NC_002031.1__C (without X-SS)
  source 1..273: mol_type = other RNA
atgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctg

SEQ ID NO: 254 - RNA, 1026 nt, synthetic construct
  misc_feature 1..1026: note = derived and/or modified CDS sequence (opt4) from YFV 17D__NC_002031.1__NS1 (without XX)
  source 1..1026: mol_type = other RNA
agagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcc

SEQ ID NO: 255 - RNA, 10233 nt, synthetic construct
  misc_feature 1..10233: note = derived and/or modified CDS sequence (opt5) from YFV 17D__NC_002031.1__polyprotein
  source 1..10233: mol_type = other RNA
atgagcggcagaaaggcccaggggaaaaccctcggagtgaacatggtgcggcgcggcgttagatccctctctaataagatcaaacaaaagacaaaacagattgggaaccggcccggacctagccgcggcgtgcaggggttcatcttcttctttctgttcaatattcttacgggaaagaagatcaccgctcacctgaaaagactctggaagatgctggacccgcggcagggccttgccgtgctgcgcaaagtgaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaagacctcgggaagacattcagcgtcggaaccggcaactgcacgaccaatatcctggaagctaaatactggtgtcccgattccatggaatataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgtttgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagagggatcttccattggaaaacttttcacacaaaccatgaaaggcgtggagagactggctgtcatgggggacacagcctgggattttagctccgcgggaggcttctttacctctgttgggaagggaatccacaccgtgttcggcagcgcctttcaggggctgttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggccgaccagggatgtgctatcaacttcggcaagagagaactgaaatgcggcgatgggattttcatctttcgggactccgatgactggctcaataagtacagctattaccccgaggatcctgtgaagctggcctctatcgttaaagcctccttcgaagagggaaagtgtggccttaacagcgtggactctctggagcatgaaatgtggcgctccagagctgacgagattaatgcgatctttgaagagaacgaagtcgatattagcgtggttgtgcaggaccccaaaaatgtctaccaacgggggacacaccctttctctcgcatcagagatggactccagtatggctggaagacctgggggaaaaacctggtgtttagccccggacggaagaatggctccttcattatcgacggcaagagccgcaaagagtgcccgttttctaacagagtgtggaactccttccagatcgaggaatttgggacaggagtcttcaccacgcgggtttacatggatgccgtgtttgagtatacaattgactgtgatggcagcatcctgggggctgccgtgaacggaaagaaatccgcccacggctctcctaccttctggatggggagccatgaagtcaatggaacctggatgattcacacacttgaggctctcgactacaaggaatgcgagtggcccctgacccatacaatcggcacgtccgtggaggaatctgagatgtttatgcctcgcagcattggcgggcccgtttcctctcacaaccacatccctggatataaagtgcagaccaatggcccctggatgcaagtcccgctggaagtgaagagagaggcctgtcctgggacaagcgttatcattgatggaaactgcgacggccgggggaagtccaccagaagcacaaccgattctggaaaagtgatccccgaatggtgctgtcgctcctgcacgatgccccctgtcagcttccatggctctgacggctgttggtacccgatggagattcggcccagaaagacccacgagtcccatctcgtgcgcagctgggtcacagcgggggaaatccacgctgtgcctttcggactggtttctatgatgattgccatggaggtggtccttcggaaaagacagggccccaagcagatgctggtcggcggggttgtgctcctgggggccatgctggtcgggcaagtgacccttctcgatctgctgaaactcacagtggctgttggactgcattttcacgaaatgaataacggcggcgacgccatgtatatggcgcttatcgctgccttctccattcgccctgggctgctcatcggatttggcctgcggaccctgtggagccccagagagcgccttgtcctgacactcggggccgctatggtggagatcgccctgggaggcgtgatgggaggcctctggaagtacctgaacgctgtctccctttgcattctgaccatcaatgccgtggcgagccggaaggcctctaacacgattctccctctgatggctctgcttacacccgttaccatggccgaagtgagactggctgccatgttcttttgtgccgtcgtgatcattggcgttctccaccagaatttcaaagacaccagcatgcagaagacaatcccgctggtggctctcaccctgacgtcctaccttggcctgacacagccttttctcgggctgtgcgcgttcctggccacccggatctttggacgcagatctattcccgtcaacgaggctcttgccgccgctggcctggtgggggttctcgccggactggcgttccaagaaatggagaattttctcggccctatcgctgtcgggggactgcttatgatgctggtcagcgtggccggccgggtggatggcctggaactcaaaaagctgggggaggtctcctgggaggaagaggccgaaatttctggaagctccgctcgctatgacgttgccctttctgagcagggcgagttcaaactgctcagcgaggagaaggtgccctgggatcaggtggtcatgacatccctggcgctcgtgggggctgccctgcatccgttcgcccttctgctggttctcgctggatggctgtttcacgtgagaggcgcccggagaagcggggacgtcctttgggatatccctacccccaaaattatcgaagagtgtgaacatctggaggacggcatctacggaattttccagtctacatttctcggcgcttcccaacgcggggtgggagttgcccagggcggggtgttccacaccatgtggcatgtcacgcggggagcgtttctggtgagaaacggcaagaagctcatccctagctgggcctctgtcaaagaagatctggtggcttatgggggctcctggaaacttgagggacgctgggacggcgaggaagaggttcagctgattgccgctgtgcccgggaaaaatgtggtcaacgttcagaccaagcccagcctgttcaaagtgcggaatggaggcgaaatcggggccgtggccctcgattacccttccggaacatctggcagcccgattgtcaacagaaatggggaggtgatcggcctgtatggaaacggcattcttgttggggacaattcctttgtgagcgctatctctcaaaccgaggtcaaggaagagggaaaggaagaactccaggaaatccccacaatgctcaaaaagggcatgaccacggtgctggatttccaccctggggcgggaaaaacacgccggtttctcccccagattctggccgagtgcgctagacgcagacttcggaccctggtcctggcccctacacgcgtggttctctccgagatgaaggaagccttccacggcctggacgtgaaatttcatacccaggctttcagcgcccacggctctgggagagaggtcatcgacgcgatgtgtcatgctacccttacataccggatgctggaacccacgcgcgtggttaactgggaggtgattatcatggatgaagcccactttctcgaccctgccagcattgctgccagaggatgggcggcccaccgggctagagccaatgagtccgctaccatcctgatgacagccaccccgcccggcacatctgatgagttccctcatagcaacggggaaatcgaggacgtccagaccgatattccctccgaaccttggaacacgggacacgactggatcctggctgataagcgccccacagcctggttcctcccgtctattcgggcggccaatgtgatggctgccagccttagaaaggctggcaaatccgtggttgtcctgaaccgcaagacctttgagcgggaatatcctaccatcaaacagaagaaacccgacttcattctggccacagatatcgccgagatgggggctaatctctgcgtggagagagtgctggactgtcggaccgcgtttaagcccgtccttgttgatgaaggacgcaaggtggccatcaaaggccctctgagaattagcgcttcttccgccgcccagcggcgcggcagaatcgggcggaaccccaatcgcgacggagatagctactactattccgagcctacatctgaaaacaatgctcatcacgtgtgctggctcgaggccagcatgctgctggacaacatggaggtcagaggcgggatggtggcgccgctctacggagttgaaggcacgaagacccccgtgtcccctggggagatgcggcttcgcgacgatcaaagaaaagtcttccgggaactggtgagaaattgcgacctgcccgtttggctctcttggcaagtggccaaggctggactgaaaacaaacgatcgcaagtggtgttttgagggccctgaagaacatgagattcttaatgacagcggcgaaaccgtcaagtgccgggcccccgggggagctaaaaagccgctgagacctcgctggtgtgatgagcgggtgtccagcgaccagtctgccctctccgagttcatcaaatttgcggagggcagacgcggggccgctgaagtgctggtcgttctgagcgagctccccgatttccttgccaagaaaggaggcgaggctatggacacaatttctgtgtttctgcactccgaagaggggagccgggcctatagaaacgctctgtctatgatgcctgaagccatgaccatcgtgatgctgttcattctggcgggacttctgacgagcggcatggtcatctttttcatgtcccccaagggcatctctcgcatgagcatggccatggggaccatggctggatgcggctacctcatgtttctcgggggagtgaaacctacacacatttcctatgttatgctgatcttcttcgtgctcatggtcgtggttattcccgagccgggccagcagcggagcatccaggataatcaggtggcctaccttattatcgggatcctgaccctggtctccgctgtggccgccaacgaactcggaatgctggagaagacaaaggaggacctttttggcaaaaagaatctgattccttctagcgcgtccccctggtcttggcccgatctcgacctgaaacctggcgctgcctggaccgtttatgtggggatcgtcacaatgctgagcccgatgctccatcactggattaaggtggaatacggaaacctttccctgtctggcatcgctcagagcgcctccgtcctgagcttcatggataaagggattccctttatgaagatgaatatctctgtgatcatgctcctggtttccggatggaacagcattacggtgatgcctcttctgtgtggcatcgggtgcgccatgctccattggtctctgattctgcccggaatcaaggctcaacagtccaaactcgcccagagacgcgtcttccacggcgtggcggagaaccctgtggttgacggcaatcccaccgtggacattgaagaggcccctgagatgccggctctttacgaaaagaaactggccctgtatctcctgcttgctctgagcctcgcctctgtcgcgatgtgtcggacacccttttccctggccgaggggatcgtgctggctagcgccgctctcggacctcttattgaaggcaacacctccctgctgtggaatgggcccatggccgttagcatgaccggagtgatgagaggcaaccactacgctttcgtcggggtgatgtataatctctggaagatgaaaacaggacgcagaggctctgccaacggcaagacgctgggggaggtctggaagcgggaacttaatctgctcgataaacgccagtttgagctgtacaagagaaccgacatcgtggaggttgatcgggacacagcgagacggcatctggccgaaggaaaagtggataccggcgtcgctgtgagccgcgggacagccaagctcagatggttccacgagcggggatatgttaaacttgaaggccgcgtgatcgacctggggtgcggcagaggaggctggtgttactatgctgccgcccaaaaggaggtctccggggtgaagggatttaccctgggccgggatgggcatgaaaaacctatgaacgtgcagtctctcggatggaatattatcacgttcaaggacaaaacagatattcaccgcctggagcccgttaagtgcgacacccttctgtgtgatatcggcgagagctcctctagctccgtcaccgaaggggagagaacagtgcgggtgctcgacaccgtcgaaaaatggctggcgtgcggcgtggacaacttttgcgttaaggtgctggctccgtacatgcctgatgtcctcgagaaacttgaactgctgcagcgcagattcggaggcacagtgattcggaatcccctctctcgcaacagcacccatgagatgtactatgtttccggggccagaagcaatgtgacgtttacagtcaaccaaacctctcggctgcttatgcgcagaatgcggagacccacaggaaaggtgaccctggaggccgacgttatcctccctatcggcacgcgctccgtggaaaccgataaggggcccctggacaaagaggctattgaggaacgggtcgagagaatcaagagcgaatacatgacatcttggttctatgataatgacaacccttaccgcacctggcactattgtggatcctacgtgacaaaaaccagcggctccgccgcttctatggtgaacggggtcattaagatcctgacatatccgtgggatcggattgaggaagttaccagaatggccatgacggacacaacccccttcggccagcagcgcgtgtttaaagagaaggtggatacccgggcgaaggaccctcccgccggaacaagaaaaatcatgaaggtcgtgaatcgctggctgttccggcacctggctagagagaagaatcctcgcctttgcaccaaggaggagtttatcgccaaagttcggagccatgctgccattggcgcgtacctggaagaacaggaacaatggaagacagccaatgaggctgtgcaggatcccaagttctgggaactcgtcgacgaggagagaaaactgcaccagcaggggcggtgtagaacgtgcgtgtacaacatgatgggaaagcgcgagaagaaactttccgagtttggcaaagccaaggggagccgggctatctggtatatgtggctgggagccagatacctcgagttcgaggctctgggctttctgaatgaagatcattgggcctctcgcgagaactccgggggcggagttgagggcattgggctccaatatctgggatacgtgatcagagaccttgcggccatggacggcgggggattctatgctgatgacaccgccggctgggatacacggattaccgaagccgacctggatgacgagcaggaaatcctcaattacatgagcccgcaccacaagaaactggctcaggccgtcatggagatgacatataagaacaaagtggtcaaggtgcttcgccctgcgcccggcgggaaggcttacatggatgttatttctagacgggaccagcgcggaagcggccaagtggtcacctacgccctgaatacgatcaccaacctcaaggtgcagctgatcagaatggccgaggctgaaatggttattcatcaccagcatgtgcaagattgtgacgagtccgtcctgacacggctcgaagcctggctgaccgagcacgggtgcgatcgccttaaaagaatggctgtgtctggagacgactgtgtggttcggcctatcgatgaccgctttggcctggccctcagccatctgaatgcgatgtccaaggtcagaaaggatatttctgaatggcagcccagcaaagggtggaacgactgggagaatgtgcctttctgctcccaccactttcatgagcttcagctgaaggatggacggcgcatcgtggtcccctgtagagaacaggacgagctcattggccggggcagagtgagcccggggaacggatggatgatcaaagaaacagcctgcctgtctaaggcttatgccaatatgtggtccctgatgtacttccacaaacgcgatatgcggctcctgagccttgctgtttcctctgccgtgcctaccagctgggtcccccaaggcagaacgacatggtccatccatgggaagggagagtggatgaccacagaagacatgctggaggtgtggaaccgcgtttggattaccaacaatccccacatgcaggataagaccatggtgaaaaagtggcgggacgtcccttatctcacaaaaagacaggataagctgtgtggctctcttatcgggatgacgaaccgcgcgacctgggccagccatattcacctggtgatccaccggattagaacactcatcggacaggagaaatacaccgactatctgacagtgatggatcgctactccgttgacgctgacctgcaactcggcgaactgatc

SEQ ID NO: 256 - RNA, 303 nt, synthetic construct
  misc_feature 1..303: note = derived and/or modified CDS sequence (opt5) from YFV 17D__NC_002031.1__C
  source 1..303: mol_type = other RNA
atgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacgg

SEQ ID NO: 257 - RNA, 363 nt, synthetic construct
  misc_feature 1..363: note = derived and/or modified CDS sequence (opt5) from YFV 17D__NC_002031.1__C-ER anchor
  source 1..363: mol_type = other RNA
atgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacggtcccatgatgtgctgacagtccaatttctcattctggggatgcttctgatgaccggaggc

SEQ ID NO: 258 - RNA, 267 nt, synthetic construct
  misc_feature 1..267: note = derived and/or modified CDS sequence (opt5) from YFV 17D__NC_002031.1__pr
  source 1..267: mol_type = other RNA
gtgaccctggtcagaaagaaccggtggctcctgcttaatgttacaagcgaggacctgggcaaaacgttctccgtggggaccggaaactgcacaaccaatatcctcgaagccaagtactggtgtcccgattctatggagtataactgccctaatctgagcccgcgcgaggaacccgacgatattgactgttggtgctacggcgtggaaaacgtcagagtggcttatgggaaatgtgattccgccggacggtctcgcagaagccggcgc

SEQ ID NO: 259 - RNA, 225 nt, synthetic construct
  misc_feature 1..225: note = derived and/or modified CDS sequence (opt5) from YFV 17D__NC_002031.1__M
  source 1..225: mol_type = other RNA
gccatcgacctgcccacccacgagaaccatggcctcaagacaagacaggaaaaatggatgacggggcggatgggagagcgccaactgcagaagattgaaagatggttcgtgcggaatccgtttttcgctgtcaccgcccttacaatcgcgtacctggttggcagcaacatgacccagcgcgtggtgattgctctcctggtccttgccgtggggcctgcctattcc

SEQ ID NO: 260 - RNA, 492 nt, synthetic construct
  misc_feature 1..492: note = derived and/or modified CDS sequence (opt5) from YFV 17D__NC_002031.1__prM
  source 1..492: mol_type = other RNA
gtgaccctggtcagaaagaaccggtggctcctgcttaatgttacaagcgaggacctgggcaaaacgttctccgtggggaccggaaactgcacaaccaatatcctcgaagccaagtactggtgtcccgattctatggagtataactgccctaatctgagcccgcgcgaggaacccgacgatattgactgttggtgctacggcgtggaaaacgtcagagtggcttatgggaaatgtgattccgccggacggtctcgcagaagccggcgcgcgatcgaccttcctacacacgagaatcatggcctgaagaccagacaggagaaatggatgacagggcggatgggagaacgccaactccagaagattgagagatggtttgttcggaaccccttctttgctgtgaccgccctgacgatcgcctacctggtcggctccaatatgacccagcgcgtggttattgctctcctggtgcttgccgtcggccctgcttattct

SEQ ID NO: 261 - RNA, 1479 nt, synthetic construct
  misc_feature 1..1479: note = derived and/or modified CDS sequence (opt5) from YFV 17D__NC_002031.1__E
  source 1..1479: mol_type = other RNA
gcccactgcatcggcattaccgacagagatttcatcgagggggtgcatggaggcacatgggtcagcgctacgctggaacaggacaagtgtgttaccgtgatggcccccgataaaccttccctcgacatttctctggagacagtggcgatcgatcggccggctgaagtccgcaaggtgtgctacaacgccgttcttacccacgtgaaaattaatgacaagtgtcccagcacaggggaggcccatctggctgaagagaacgagggagataatgcctgcaaaagaacctattccgaccggggctgggggaacggatgtggcctctttggcaaggggtctatcgtcgcttgcgccaagttcacatgtgcgaaaagcatgtccctgtttgaagtggatcaaaccaagatccagtacgttattcgcgcccagcttcacgtgggagctaaacaggagaattggaacacggacatcaagaccctgaaattcgatgccctctctggcagccaagaagtcgagtttattgggtatggaaaggctacactggagtgccaggtgcagaccgccgtggacttcggcaattcctacatcgcggaaatggagacagaaagctggattgtcgatagacagtgggcccaagacctgaccctcccttggcagtctgggtccggaggcgtttggcgggagatgcatcacctggtggaatttgagccccctcacgctgccacgatccgcgtgcttgctctgggcaaccaggaggggagcctcaagacagccctgaccggagccatgagagtcacaaaagacaccaatgataacaatctttataagctgcatggcgggcacgtgtcttgtcgggttaaactctccgctctgaccctgaagggaacaagctacaaaatttgcacggacaagatgttctttgtgaaaaaccccaccgatacaggccatgggaccgtcgtgatgcaggttaaggtgtctaagggagcgccttgtcgcatcccggtcatcgtggccgacgatctcacagctgccattaataaaggcatcctggtcaccgtgaaccccattgcctccacgaatgacgatgaagttcttatcgaggtgaaccctcccttcggcgacagctatattatcgtcgggagaggagattcccggctgacataccaatggcacaaggaaggctctagcatcgggaaactctttacccagaccatgaagggagtggagcgcctggctgttatgggcgacacagcctgggatttctccagcgctgggggctttttcacctctgtgggaaaaggcattcacacagtcttcgggtccgcgtttcagggacttttcggcgggctgaactggatcacgaaggtgattatgggagccgtgctcatctgggttggcattaataccagaaacatgacaatgagcatgtctatgatcctggtcggggtgatcatgatgtttctgagcctcggcgtgggagcc

SEQ ID NO: 262 - RNA, 1971 nt, synthetic construct
  misc_feature 1..1971: note = derived and/or modified CDS sequence (opt5) from YFV 17D__NC_002031.1__prME
  source 1..1971: mol_type = other RNA
gtgaccctggtcagaaagaaccggtggctcctgcttaatgttacaagcgaggacctgggcaaaacgttctccgtggggaccggaaactgcacaaccaatatcctcgaagccaagtactggtgtcccgattctatggagtataactgccctaatctgagcccgcgcgaggaacccgacgatattgactgttggtgctacggcgtggaaaacgtcagagtggcttatgggaaatgtgattccgccggacggtctcgcagaagccggcgcgcgatcgaccttcctacacacgagaatcatggcctgaagaccagacaggagaaatggatgacagggcggatgggagaacgccaactccagaagattgagagatggtttgttcggaaccccttctttgctgtgaccgccctgacgatcgcctacctggtcggctccaatatgacccagcgcgtggttattgctctcctggtgcttgccgtcggccctgcttattctgcccactgcatcgggatcacagatagagacttcattgaaggagtgcatggcgggacctgggtgagcgcgacactggagcaggataagtgtgtcaccgttatggcccccgacaaaccttccctcgatatcagcctggagacggtggctattgaccggccggccgaagtgcgcaaggtctgctacaacgctgtgcttacacacgttaaaatcaatgataagtgtccctctaccggagaggcccatctggcggaagagaacgaaggcgacaatgcctgcaaaagaacatattccgaccgggggtggggaaacggctgtggcctctttgggaagggaagcattgtggcttgcgccaagtttacctgcgctaaatctatgtccctgttcgaggtcgatcaaaccaagatccagtacgtgattagagcccagctgcacgttggcgccaaacaggagaattggaacacagacatcaagacgctcaaattcgatgctctgagcgggtctcaagaagtggagtttatcggatacggcaaggcgacccttgaatgtcaggtccagacagccgtggacttcgggaactcctatattgctgagatggaaaccgagagctggatcgtcgatcgccagtgggcccaagacctgacactcccttggcagtccggatctggcggcgtgtggcgggagatgcaccatctggttgaatttgagccccctcacgccgctaccattagagtgcttgccctggggaatcaggaaggaagcctcaaaacggcgctgacaggcgctatgcgcgtcaccaaggataccaacgacaataacctgtacaagctccatgggggacacgtgtcctgccgggttaaactgagcgcccttacactgaagggcacctcttataaaatctgtacagataagatgttctttgtgaaaaatcccacggacaccgggcacggcacagtcgtgatgcaagtgaaggtttccaagggagccccgtgccgcattcctgtcatcgtggctgatgacctcaccgccgctatcaacaaaggcattctggtgacagtcaatcccatcgccagcaccaacgacgatgaggtgcttattgaagttaatcctcccttcggggactcttacatcattgtgggaagaggcgatagccggctgacgtatcagtggcataaggaggggtcctctatcggaaaactcttcacccagacaatgaagggcgtcgagagactggcggtgatgggggacaccgcctgggattttagctccgctggcggattctttacaagcgttggcaaagggatccacaccgtgttcggatctgcctttcagggcctgttcgggggactcaactggattacgaaggtcatcatgggcgctgtgctgatttgggttgggatcaatacacgcaacatgaccatgtccatgagcatgattcttgtgggcgtcatcatgatgtttctgtctctcggagtgggcgcc

SEQ ID NO: 263 - RNA, 2031 nt, synthetic construct
  misc_feature 1..2031: note = derived and/or modified CDS sequence (opt5) from YFV 17D__NC_002031.1__ER anchor-prME
  source 1..2031: mol_type = other RNA
agccacgacgtgctgaccgtccagttcctcatcctgggcatgcttctgatgacagggggagttacgctcgtgagaaagaaccggtggctgcttctgaatgtgacctccgaggatctcggcaaaacattttctgtcgggaccggaaactgcacaaccaatattctggaagccaagtactggtgtcccgacagcatggagtataactgccctaatctgtccccgcgcgaagaacccgatgacatcgattgttggtgctacggcgtggaaaacgttagagtggcttatgggaaatgtgactctgccggacggagccgcagatcccggcgcgcgattgatctccctacacatgagaatcacggcctgaagaccagacaagagaaatggatgacgggccggatgggggaacgccagcttcagaagatcgagagatggttcgtccggaacccctttttcgctgtgaccgccctgacaattgcctacctcgttggatctaatatgacccagcgcgtggtcatcgctctgcttgtgctggccgtgggccctgcttatagcgcccattgcatcgggattacagacagagattttatcgaaggagtccacggcgggacctgggtttccgcgacgctcgagcaagacaagtgtgtgacagtgatggcccccgataaacctagcctggacatttctctggagaccgtcgctatcgatcggccggccgaagtgcgcaaggtttgctacaacgctgtgctcacacatgtcaaaattaatgacaagtgtccctccaccggagaggcccacctggcggaagagaacgaaggcgacaatgcctgcaaaagaacctatagcgatcggggctgggggaacggatgtggccttttcgggaagggatctatcgtggcttgcgccaagtttacatgcgctaaatccatgagcctgttcgaggttgaccagacgaagattcagtacgtgatcagagcccagctccacgtcggcgccaaacaagagaattggaacaccgatatcaagacactgaaatttgacgctctttctgggtcccaggaagtggagttcattggatacggcaaggcgaccctggaatgtcaggtccagacagccgtggattttggcaacagctatatcgctgagatggaaaccgagtcctggattgttgaccgccaatgggcccaggatctcacgctgccttggcagtctgggagcggaggcgtgtggcgggagatgcatcacctggtcgagttcgagccccctcatgccgctacaatcagagtgctcgccctggggaatcaagaaggatcccttaaaaccgcgctgaccggcgctatgcgcgttacaaaggacaccaacgataataacctctacaagctgcacgggggccacgtgagctgccgggtcaaactttctgccctgacactcaagggaacgtcctataaaatttgtaccgacaagatgtttttcgtgaaaaatcccacagataccggccatgggacagtggttatgcaggtcaaggtgagcaagggagccccgtgcagaatccctgtgatcgtcgctgacgacctgaccgccgctattaacaaaggcatcctggtgacggttaatcccattgcctctaccaacgatgacgaggtgctcatcgaagtcaatcctcccttcggggatagctacattatcgtgggacgcggcgactcccggctgacatatcagtggcacaaggaggggtctagcatcggcaaactttttacccagacaatgaagggagttgagagactggcggtgatgggcgataccgcctgggacttctccagcgctgggggatttttcacgtctgtcggcaaagggattcatacagtgtttggatccgccttccaaggcctctttgggggcctgaactggatcaccaaggttattatgggagctgtgctgatctgggtcggcattaatacacgcaacatgaccatgagcatgtctatgatccttgtgggggtgattatgatgttcctctccctgggagtcggcgcc

SEQ ID NO: 264 - RNA, 1056 nt, synthetic construct
  misc_feature 1..1056: note = derived and/or modified CDS sequence (opt5) from YFV 17D__NC_002031.1__NS1
  source 1..1056: mol_type = other RNA
gaccagggctgcgccatcaacttcgggaagagagagctgaaatgtggagatggcatttttatcttccgggacagcgatgactggctcaataagtactcctattaccccgaagatcctgtgaaactggcttctattgtcaaggccagctttgaggaagggaaatgcggacttaactccgttgactctctggagcacgaaatgtggcgcagcagagcggatgagatcaatgctattttcgaggaaaacgaggtggacatctccgtggtcgtgcaggatccgaagaatgtttatcagcggggcacccatcccttttctcgcatcagagacgggctccagtacggatggaagacatggggcaaaaacctggtgttcagccctggccggaagaatgggtcctttattatcgatggaaaaagccgcaaggaatgtcccttctctaacagagtctggaactcctttcagattgaggagttcggcacgggggtgtttaccacacgggtttatatggacgccgtgttcgaatacaccatcgattgcgacggaagcattcttggcgccgctgtcaatgggaaaaagtctgcccacggatcccctacattttggatgggcagccatgaggtgaatggcacctggatgatccacacactggaagctctcgactataaggagtgtgaatggcccctgacccatacgattgggacctctgtggaggagtccgaaatgttcatgcctcgcagcatcggaggcccggtctcctctcacaaccacatccccgggtacaaagttcaaacaaatggaccttggatgcaagtgcccctggaggtgaagagagaagcctgccctggcaccagcgtcattatcgatgggaactgtgacggacggggcaaatccacacgcagcaccacggattctggcaaggtgattcccgagtggtgctgtagatcctgcacaatgccgcctgttagcttccatgggtctgacggatgttggtaccccatggaaatccggcctcgcaaaacccacgagagccatctcgtgagatcctgggtcacagcg

SEQ ID NO: 265 - RNA, 672 nt, synthetic construct
  misc_feature 1..672: note = derived and/or modified CDS sequence (opt5) from YFV 17D__NC_002031.1__NS2A
  source 1..672: mol_type = other RNA
ggcgagatccacgccgtgcccttcgggctggtcagcatgatgattgctatggaagttgtgctcagaaagcggcagggacctaaacaaatgctggtgggcggggtcgtgcttctgggagccatgctcgttggccaggtgaccctgcttgacctgctcaagctgacagtcgcggtggggctgcattttcacgagatgaacaatggaggcgatgctatgtacatggccctcatcgccgctttctccattcgcccgggcctgcttatcgggtttggactgagaacgctctggtctccccgggaacgcctggttcttaccctgggcgccgctatggtggagattgccctcgggggagtcatgggcgggctgtggaaatatctgaacgcggtgagcctctgcatcctgacaatcaatgccgtggcttccagaaaggcctctaacaccattcttcctctgatggctctcctgacacccgtcaccatggccgaagttcggcttgcggccatgttcttttgtgctgtggtgatcattggagtcctgcatcagaatttcaaagacacaagcatgcagaagaccatccctctcgtggccctgacgctgacctcctacctcggcctgacacaaccctttcttggcctgtgcgctttcctcgccacccgcatttttgggagacgg

SEQ ID NO: 266 - RNA, 390 nt, synthetic construct
  misc_feature 1..390: note = derived and/or modified CDS sequence (opt5) from YFV 17D__NC_002031.1__NS2B
  source 1..390: mol_type = other RNA
agcatccccgtgaacgaggccctggctgccgcgggcctcgtcggggttctggctggacttgccttccaggaaatggagaattttctgggccctattgccgtcgggggactcctgatgatgcttgtgtccgtggctggcagagtggacgggctggaactcaagaaactgggagaggtttcttgggaagaggaggccgaaatcagcggctcctctgctcggtacgatgtggccctgagcgagcaaggcgagttcaagctcctgtccgaagagaaagtcccgtgggaccaggtggttatgacctctcttgcgctggtgggggccgctctccacccctttgccctgcttctggtcctcgctggatggctgttccatgtgcgcggcgccagacgg

SEQ ID NO: 267 - RNA, 1869 nt, synthetic construct
  misc_feature 1..1869: note = derived and/or modified CDS sequence (opt5) from YFV 17D__NC_002031.1__NS3
  source 1..1869: mol_type = other RNA
agcggcgacgtgctgtgggatatccccacccctaagattatcgaggaatgcgagcacctcgaagacgggatttacggaatcttccagtccacatttctgggcgcctctcaaagaggggtcggagttgctcagggcggggtgttccatacgatgtggcacgtgacccggggagcctttcttgtccgcaacggcaaaaagctgattccgagctgggcgtccgtgaaagaggatctcgttgcttatggcgggtcttggaagctggaaggaagatgggacggcgaggaggaagtgcagcttatcgccgccgtccccgggaaaaatgtggttaacgtgcagacaaagcctagcctgttcaaggtccggaatggaggcgagatcggggctgtggccctcgattacccctccggaacctctggcagccctattgtgaaccgcaatggcgaagtcatcgggctgtatggaaacggcattctggttggggacaattcctttgtgagcgctatctctcaaacagaggtgaaagaggaaggaaaggaggaactccaggagattcccaccatgctgaaaaagggcatgacaaccgtccttgatttccatcctggggccggaaaaacgagacggtttctgccgcagatcctcgcggaatgtgcccgcagacggctgcgcacccttgtgctggctcccacaagagttgtgctctccgagatgaaggaggccttccacggcctggacgtcaagtttcatacccaggctttcagcgcccacggctctgggcgggaagtgattgatgcgatgtgccacgccacactgacctaccgcatgctcgagcctacgagagttgtgaactgggaagtcatcatcatggacgaggctcattttctggatcccgcctccattgctgcccggggatgggccgctcaccgcgcgagagccaatgaaagcgctacaatccttatgaccgccacacctcccggcacctctgacgagttcccgcattccaacggggagattgaagatgtgcaaaccgacatccctagcgagccctggaatacaggacacgactggattctggccgataaacggcctacggcttggtttctcccctccatcagagccgcgaacgtcatggctgcctctctgcgcaaggccggcaaaagcgtggttgtgcttaatcggaagaccttcgaaagagagtatcccacaatcaaacagaagaaacctgacttcattctggctaccgatatcgccgaaatgggggctaacctctgtgtcgagcgcgtgctggactgccggacagcctttaagccggttctggtggatgagggcagaaaggtcgcgattaaaggacccctccgcatctccgccagctctgctgcccagcggagaggccgcattgggcggaatcctaacagagacggagattcctactattacagcgaacccacctctgagaacaatgctcaccatgtgtgttggctggaagccagcatgcttctggacaacatggaggtgcgcggcgggatggttgcgcctctctacggagtcgagggcacgaagacacccgtgtccccgggggaaatgcggctgagagatgaccagcggaaagtgttccgcgagcttgtcagaaattgcgatctgcctgtgtggctctcttggcaagttgccaaggctggcctgaaaaccaacgaccggaagtggtgttttgaaggacccgaggaacacgagatcctgaatgacagcggcgagaccgtgaagtgcagagcccctgggggagctaaaaagcccctccgccctcggtggtgtgatgaaagagtctccagcgaccagtctgccctgtccgagttcatcaaatttgccgaaggccgcaga

SEQ ID NO: 268 - RNA, 447 nt, synthetic construct
  misc_feature 1..447: note = derived and/or modified CDS sequence (opt5) from YFV 17D__NC_002031.1__NS4A-P2K
  source 1..447: mol_type = other RNA
ggcgccgctgaggtgctggtcgttctcagcgaactgcccgacttccttgccaagaaagggggagaggcgatggataccatctccgtgtttctgcactctgaagagggcagcagagcttaccggaacgccctctccatgatgcctgaagccatgacaattgtgatgctgttcatccttgctgggctgctcacgtctggaatggtcatctttttcatgagcccgaagggcatttcccgcatgtctatggccatggggaccatggctggatgcggctatctgatgtttctgggcggggtgaaacccacacatattagctacgttatgctcatcttctttgtgctgatggtcgtggttatccctgagcccggacagcaaagatccattcaggacaatcaggtggcctatcttatcattggcatcctgaccctcgtcagcgcggtggccgct

SEQ ID NO: 269 - RNA, 750 nt, synthetic construct
  misc_feature 1..750: note = derived and/or modified CDS sequence (opt5) from YFV 17D__NC_002031.1__NS4B
  source 1..750: mol_type = other RNA
aacgagctgggcatgctcgaaaagaccaaagaggacctgttcgggaagaaaaatcttatccccagctccgcctctccttggagctggccggatctggacctcaagcccggagctgcctggacagtgtacgtcggcattgttacgatgctgtcccctatgcttcaccattggatcaaagtggaatatgggaacctgtctctcagcggaattgcgcagtccgcttctgtgctgagctttatggataagggcatccccttcatgaagatgaatatttccgtcatcatgctgctcgtgagcgggtggaactctatcaccgttatgcctctgctttgcggaattggctgtgccatgctgcactggtccctcatcctgcccggcattaaagcccaacagagcaaacttgctcagagacgggtgtttcatggggtcgccgagaatcctgtggttgacggaaacccgacagtggatatcgaagaggctcccgagatgcctgccctgtacgaaaagaagctcgcgctgtatctgctcctggccctttctctggcttccgtcgccatgtgccgcacccccttcagcctcgctgagggcattgtgctggcctctgcggcccttgggcctctgatcgaaggaaatacatccctcctgtggaacggccccatggctgtgagcatgaccggggtcatgagaggaaatcactacgcctttgttggcgtgatgtataacctgtggaaaatgaagacaggccggcgc

SEQ ID NO: 270 - RNA, 2715 nt, synthetic construct
  misc_feature 1..2715: note = derived and/or modified CDS sequence (opt5) from YFV 17D__NC_002031.1__NS5
  source 1..2715: mol_type = other RNA
ggcagcgccaacgggaagaccctgggagaggtgtggaaaagagaactcaatctgcttgacaagcggcagttcgagctgtacaaacgcacagatatcgtcgaagttgacagagatacggctcggcgccacctcgccgagggcaaggtggacaccggggtggcggtctccagaggaacagctaaactgcggtggtttcatgaacgcggctatgtgaaacttgaggggagagttattgatctgggatgcggccggggcgggtggtgttactatgccgccgctcaaaaggaggtgtctggagtcaagggcttcaccctcgggcgcgacggacacgaaaagcccatgaacgtgcagagcctgggctggaatatcattacatttaaagataagaccgacatccatagactggagcctgttaaatgcgatacactcctgtgtgacattggggaatcctctagctcctctgtgaccgagggagagcggacggtccgcgtgcttgataccgtggaaaagtggctggcctgcggcgtcgacaacttctgtgttaaggtgctcgctccgtacatgcccgatgtgctggagaaacttgaactgctccagagacggtttggcgggacagtcatccgcaatcctctgagcagaaactccacccacgagatgtattacgtgagcggagcccggtctaatgttacattcaccgtgaaccagacgtccagactgctcatgcgccggatgagacgccccacaggcaaggtcaccctggaagcggacgtgatccttcctattgggacacggagcgttgagaccgacaaaggacccctggataaggaggccatcgaagagagagtggaacgcattaaatctgagtatatgacctcctggttttacgacaatgataacccttaccggacatggcattattgcggcagctacgtcacgaagacctctgggtccgctgccagcatggtgaatggagtcatcaaaattctcacatatccgtgggacagaatcgaagaggtgacccgcatggctatgacagataccacgcccttcggccaacagcgggtttttaaggagaaggtggacacaagagccaaagatcctcccgcgggcacccgcaagattatgaaagtcgtgaaccggtggctgttcagacaccttgcccgggaaaagaatcctcgcctgtgtaccaaagaggaatttatcgctaaggttagatcccacgccgctatcggggcctacctcgaggaacaggagcagtggaagacagccaacgaggctgtgcaagaccccaaattctgggaactggtcgatgaggaacggaagctgcatcagcagggaagatgccgcacctgtgtgtataatatgatgggcaaacgggagaagaaactctctgagtttgggaaggcgaagggaagcagagccatttggtacatgtggctgggcgctcgctatcttgagttcgaagccctggggttcctcaacgaagaccactgggcctccagagagaacagcggcggaggcgtggaagggatcggactgcagtaccttggctacgttattcgggatctggctgccatggacgggggaggcttttatgcggacgatacagctgggtgggacacgcgcatcaccgaggccgatctcgacgatgagcaagaaattctgaattacatgtctccgcatcacaaaaagctggcccaggctgtcatggagatgacatataaaaacaaggtggtgaaagtcctcagacctgcccccggcggaaaggcttacatggacgtgatctcccggcgcgatcagagaggcagcgggcaagttgtgacctatgccctgaatacaatcaccaaccttaaggtccagctgattcggatggcggaagccgagatggtgatccaccatcagcacgttcaggactgcgatgaatctgtgctcacgcgcctggaggcttggctgaccgagcatggatgtgacagacttaaacggatggccgtcagcggcgatgactgcgtggttcgccctattgatgacagattcgggctcgctctgtcccacctgaatgccatgtctaaggtgcggaaagacatcagcgaatggcaaccctccaagggatggaacgattgggagaatgtccccttttgcagccatcacttccacgaactccagctgaaagacggcagacgcattgtggtgccttgtcgggagcaggatgaacttatcgggagaggccgcgtctctccgggaaacggctggatgatcaaggagacagcgtgcctgtccaaagcctacgctaatatgtggagcctcatgtattttcataagcgggacatgagactgctgtctcttgccgtttccagcgctgtgcccacctcctgggtgcctcaggggcgcacaacctggtctattcacggaaagggcgagtggatgacgacagaagatatgctcgaggtctggaaccgggtgtggatcaccaataacccccatatgcaagacaaaacaatggttaagaaatggagagatgtgccttacctgaccaagcgccaggacaaactgtgtgggagcctcattggaatgaccaatcgggccacatgggcctcccacatccacctggtcattcatagaatccggacgcttattggccaggaaaagtacaccgattatctgacagtgatggaccgctactctgttgatgctgacctccagctgggggagctgatc

SEQ ID NO: 271 - RNA, 2334 nt, synthetic construct
  misc_feature 1..2334: note = derived and/or modified CDS sequence (opt5) from YFV 17D__NC_002031.1__C-prME
  source 1..2334: mol_type = other RNA
atgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaggacctcgggaagacattcagcgtcggaaccggcaactgcacgaccaatatcctggaagctaaatactggtgtcccgattccatggagtataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgttcgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagaggggtcttccattggaaaacttttcacacagaccatgaagggcgtggagagactggctgtcatgggggacacagcctgggattttagctccgcgggaggcttctttacctctgttgggaagggaatccacaccgtgttcggcagcgcctttcagggcctcttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggcc

SEQ ID NO: 272 - RNA, 3390 nt, synthetic construct
  misc_feature 1..3390: note = derived and/or modified CDS sequence (opt5) from YFV 17D__NC_002031.1__C-prME-NS1
  source 1..3390: mol_type = other RNA
atgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaggacctcgggaagacattcagcgtcggaaccggcaactgcacgaccaatatcctggaagctaaatactggtgtcccgattccatggagtataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgttcgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagaggggtcttccattggaaaacttttcacacagaccatgaagggcgtggagagactggctgtcatgggggacacagcctgggattttagctccgcgggaggcttctttacctctgttgggaagggaatccacaccgtgttcggcagcgcctttcagggcctcttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggccgaccagggatgtgctatcaacttcggcaagagagaactgaaatgcggcgatgggattttcatctttcgggactccgatgactggctcaataagtacagctattaccccgaggatcctgtgaagctggcctctatcgttaaagcctccttcgaagagggaaagtgtggccttaacagcgtggactctctggagcatgaaatgtggcgctccagagctgacgagattaatgcgatctttgaagagaacgaagtcgatattagcgtggttgtgcaggaccccaaaaatgtctaccaacgggggacacaccctttctctcgcatcagagatggactccagtatggctggaagacctgggggaaaaacctggtgtttagccccggacggaagaatggctccttcattatcgacggcaagagccgcaaagagtgcccgttttctaacagagtgtggaactccttccagatcgaggaatttgggacaggagtcttcaccacgcgggtttacatggatgccgtgtttgagtatacaattgactgtgatggcagcatcctgggggctgccgtgaatggaaagaaatccgcccacggctctcctaccttctggatggggagccatgaagtcaatggaacctggatgattcacacacttgaggctctcgactacaaggaatgcgagtggcccctgacccatacaatcggcacgtccgtggaggaatctgagatgtttatgcctcgcagcattggcgggcccgtttcctctcacaaccacatccctggatataaagtgcagaccaatggcccctggatgcaagtcccgctggaagtgaagagagaggcctgtcctgggacaagcgttatcattgatggaaactgcgacggccgggggaagtccaccagaagcacaaccgattctggaaaagtgatccccgaatggtgctgtcgctcctgcacgatgccccctgtcagcttccatggctctgacggctgttggtacccgatggagattcggcccagaaagacccacgagtcccatctcgtgcgcagctgggtcacagcg

SEQ ID NO: 273 - RNA, 30 nt, synthetic construct
  misc_feature 1..30: note = derived and/or modified CDS sequence (opt5) from YFV 17D__NC_002031.1__X or 10aa (5'-terminus)
  source 1..30: mol_type = other RNA
atgagaggcctgagctcccggaagcgcaga

SEQ ID NO: 274 - RNA, 60 nt, synthetic construct
  misc_feature 1..60: note = derived and/or modified CDS sequence (opt5) from YFV 17D__NC_002031.1__SS or ER anchor (v1)
  source 1..60: mol_type = other RNA
agccacgacgtgctgaccgtccagttcctcatcctgggcatgcttctgatgacaggggga

SEQ ID NO: 275 - RNA, 54 nt, synthetic construct
  misc_feature 1..54: note = derived and/or modified CDS sequence (opt5) from YFV 17D__NC_002031.1__SS or ER anchor (v2)
  source 1..54: mol_type = other RNA
gacgtgctgaccgtccagttcctcatcctgggcatgcttctgatgacaggggga

SEQ ID NO: 276 - RNA, 72 nt, synthetic construct
  misc_feature 1..72: note = derived and/or modified CDS sequence (opt5) from YFV 17D__NC_002031.1__SS or ER anchor (v4)
  source 1..72: mol_type = other RNA
agccacgacgtgctgaccgtccagttcctcatcctgggcatgcttctgatgacagggggagttacgctcgtg

SEQ ID NO: 277 - RNA, 90 nt, synthetic construct
  misc_feature 1..90: note = derived and/or modified CDS sequence (opt5) from YFV 17D__NC_002031.1__X-SS or 10aa (5'-terminus)-SS (v1)
  source 1..90: mol_type = other RNA
atgagaggcctgagctcccggaagcgcagatctcacgacgtgctcaccgtccagttcctgatccttgggatgctgctcatgacaggaggc

SEQ ID NO: 278 - RNA, 102 nt, synthetic construct
  misc_feature 1..102: note = derived and/or modified CDS sequence (opt5) from YFV 17D__NC_002031.1__X-SS or 10aa (5'-terminus)-SS (v2)
  source 1..102: mol_type = other RNA
atgagaggcctgagctcccggaagcgcagatctcacgacgtgctcaccgtccagttcctgatccttgggatgctgctcatgacaggaggcgttacgctggtg

SEQ ID NO: 279 - RNA, 30 nt, synthetic construct; identical to SEQ ID NO: 118
  misc_feature 1..30: note = derived and/or modified CDS sequence (opt5) from YFV 17D__NC_002031.1__XX or 10aa (3'-terminus)
  source 1..30: mol_type = other RNA

SEQ ID NO: 280 - RNA, 2091 nt, synthetic construct
  misc_feature 1..2091: note = derived and/or modified CDS sequence (opt5) from YFV 17D__NC_002031.1__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaacaccgatatcaaaacacttaagtttgacgctctgagcggatcccaggaagtggagttcattggctacggcaaagcgaccctcgaatgtcaggtccagacagccgtggattttgggaactcttatatcgctgagatggaaaccgagagctggattgttgaccggcaatgggcccaggatctgacgctgccttggcagtccggaagcggcggggtgtggagagagatgcatcacctcgtcgagttcgagccccctcatgccgctacaatccgcgtgctggcccttggaaatcaagaaggctctctgaagaccgcgctcaccggggctatgcgggttacaaaggacaccaacgataataacctgtacaaacttcacggcggacacgtgtcctgcagagtcaagctgagcgccctcacactgaaaggcacgtcttataagatttgtaccgacaaaatgtttttcgtgaagaatcccacagataccgggcatggaacagtggttatgcaggtcaaggtgagcaaaggcgccccgtgccgcatccctgtgatcgtcgctgacgacctgaccgccgctattaacaaggggatcctcgtgacggttaatcccattgcctccaccaacgatgacgaggtgctgatcgaagtcaatcctcccttcggagattcttacattatcgtgggccggggagacagcagacttacatatcagtggcacaaagagggctccagcatcggaaagctgtttacccagacaatgaaaggcgttgagcgcctcgcggtgatgggggataccgcctgggacttctcttccgctggaggctttttcacgagcgtcgggaaggggattcatacagtgtttggctctgccttccaagggctgtttggcggactgaactggatcaccaaggttattatgggcgctgtgcttatctgggtcgggattaatacacggaacatgaccatgtccatgagcatgatcctcgtgggagtgattatgatgttcctgtccctgggcgtcggggccgatcagggatgtgcgatcaattttggcaaa

SEQ ID NO: 281 - RNA, 1581 nt, synthetic construct
  misc_feature 1..1581: note = derived and/or modified CDS sequence (opt5) from YFV 17D__NC_002031.1__X-SS-E
  source 1..1581: mol_type = other RNA
atgagaggcctgagctcccggaagcgcagatctcacgacgtgctcaccgtccagttcctgatccttgggatgctgctcatgacaggaggcgttacgctggtggcccattgcattgggatcaccgatcgggactttattgagggagtgcacggcgggacatgggtcagcgctacccttgaacaagataaatgtgtgacagttatggcccccgacaagccttccctggatatctctctcgagaccgtggcgattgaccgcccggctgaagtcagaaaagtgtgctacaacgccgttctgacacatgtgaagatcaatgataaatgtcccagcaccggagaggcccacctggctgaagagaacgagggcgacaatgcctgcaagcggacgtattccgatcgcggctgggggaacggatgtggcctcttcgggaagggatctatcgtcgcttgcgccaaatttacctgtgccaagagcatgtccctgttcgaagtggaccagacaaaaattcagtacgtgatcagagcgcagcttcatgtcggcgctaagcaagagaattggaacaccgatattaaaacactgaagtttgacgccctcagcgggtctcaggaagttgagttcatcggatatggcaaggctaccctggagtgccaggtgcagacggccgtggattttggcaattcctacattgcggaaatggagacagaaagctggatcgtcgaccggcaatgggcccaggaccttaccctgccttggcagtctgggtccggaggcgtgtggcgcgagatgcaccacctcgttgagttcgaaccccctcatgctgccacaattagagtgctggctctggggaaccaggagggaagcctcaaaaccgccctgaccggcgccatgcgggtcacaaaggatacgaatgacaacaatctttataaactgcacgggggacatgtgtcttgtcgcgttaagctctccgctctgacccttaaaggcacaagctacaagatctgcaccgataaaatgtttttcgtgaagaaccccacagacaccggccacgggacggtcgtgatgcaagtcaaggtgtccaaaggagcgccttgtagaatcccggttattgtggccgatgacctgacagctgccatcaataagggcattctcgtcaccgtgaaccccatcgcctctaccaatgatgacgaagttctgattgaggtgaaccctccctttggggatagctatatcatcgtcggacggggcgactcccgcctgacataccagtggcacaaagaagggagctctattggcaaactcttcacccagacaatgaagggagtggagagactggctgtgatgggcgatacggcctgggacttttccagcgctgggggattcttcacctctgttggcaaggggatccatacagtctttggaagcgcgttccaaggcctttttgggggcctgaactggattaccaaggtgatcatgggagccgtgctcatttgggtcggcatcaatacacggaacatgaccatgtccatgtctatgatcctggtgggggttattatgatgttccttagcctgggagtgggcgcc

SEQ ID NO: 282 - RNA, 1611 nt, synthetic construct
  misc_feature 1..1611: note = derived and/or modified CDS sequence (opt5) from YFV 17D__NC_002031.1__X-SS-E-XX
  source 1..1611: mol_type = other RNA
atgagaggcctgagctcccggaagcgcagatctcacgacgtgctcaccgtccagttcctgatccttgggatgctgctcatgacaggaggcgttacgctggtggcccattgcattgggatcaccgatcgggactttattgagggagtgcacggcgggacatgggtcagcgctacccttgaacaagataaatgtgtgacagttatggcccccgacaagccttccctggatatctctctcgagaccgtggcgattgaccgcccggctgaagtcagaaaagtgtgctacaacgccgttctgacacatgtgaagatcaatgataaatgtcccagcaccggagaggcccacctggctgaagagaacgagggcgacaatgcctgcaagcggacgtattccgatcgcggctgggggaacggatgtggcctcttcgggaagggatctatcgtcgcttgcgccaaatttacctgtgccaagagcatgtccctgttcgaagtggaccagacaaaaattcagtacgtgatcagagcgcagcttcatgtcggcgctaagcaagagaattggaacaccgatattaaaacactgaagtttgacgccctcagcgggtctcaggaagttgagttcatcggatatggcaaggctaccctggagtgccaggtgcagacggccgtggattttggcaattcctacattgcggaaatggagacagaaagctggatcgtcgaccggcaatgggcccaggaccttaccctgccttggcagtctgggtccggaggcgtgtggcgcgagatgcaccacctcgttgagttcgaaccccctcatgctgccacaattagagtgctggctctggggaaccaggagggaagcctcaaaaccgccctgaccggcgccatgcgggtcacaaaggatacgaatgacaacaatctttataaactgcacgggggacatgtgtcttgtcgcgttaagctctccgctctgacccttaaaggcacaagctacaagatctgcaccgataaaatgtttttcgtgaagaaccccacagacaccggccacgggacggtcgtgatgcaagtcaaggtgtccaaaggagcgccttgtagaatcccggttattgtggccgatgacctgacagctgccatcaataagggcattctcgtcaccgtgaaccccatcgcctctaccaatgatgacgaagttctgattgaggtgaaccctccctttggggatagctatatcatcgtcggacggggcgactcccgcctgacataccagtggcacaaagaagggagctctattggcaaactcttcacccagacaatgaagggagtggagagactggctgtgatgggcgatacggcctgggacttttccagcgctgggggattcttcacctctgttggcaaggggatccatacagtctttggaagcgcgttccaaggcctttttgggggcctgaactggattaccaaggtgatcatgggagccgtgctcatttgggtcggcatcaatacacggaacatgaccatgtccatgtctatgatcctggtgggggttattatgatgttccttagcctgggagtgggcgccgaccaggggtgcgctatcaattttggaaaa

SEQ ID NO: 283 - RNA, 2025 nt, synthetic construct
  misc_feature 1..2025: note = derived and/or modified CDS sequence (opt5) from YFV 17D__NC_002031.1__SS-prME
  source 1..2025: mol_type = other RNA
gacgtgctgaccgtccagttcctcatcctgggcatgcttctgatgacagggggagttacgctcgtgagaaagaaccggtggctgcttctgaatgtgaccagcgaggatctcggcaaaacattttccgtcgggaccggaaactgcacaaccaatattctggaagccaagtactggtgtcccgactctatggagtataactgccctaatctgagcccgcgcgaagaacccgatgacatcgattgttggtgctacggcgtggaaaacgttagagtggcttatgggaaatgtgactccgccggacggtctcgcagaagccggcgcgcgattgatctccctacacacgagaatcatggcctgaagaccagacaagagaaatggatgacgggccggatgggggaacgccagcttcagaagatcgagagatggttcgtccggaacccctttttcgctgtgaccgccctgacaattgcctacctcgttggatccaatatgacccagcgcgtggtcatcgctctgcttgtgctggccgtgggccctgcttattctgcccactgcatcgggattacagacagagattttatcgaaggagtccatggcgggacctgggttagcgcgacgctcgagcaagacaagtgtgtgacagtgatggcccccgataaaccttccctggacattagcctggagaccgtcgctatcgatcggccggccgaagtgcgcaaggtttgctacaacgctgtgctcacacacgtcaaaattaatgacaagtgtccctctaccggagaggcccatctggcggaagagaacgaaggcgacaatgcctgcaaaagaacctattccgatcggggctgggggaacggatgtggccttttcgggaagggaagcatcgtggcttgcgccaagtttacatgcgctaaatctatgtccctgttcgaggttgaccagacgaagattcagtacgtgatcagagcccagctccacgtcggcgccaaacaagagaattggaacaccgatatcaagacactgaaatttgacgctcttagcgggtctcaggaagtggagttcattggatacggcaaggcgaccctggaatgtcaggtccagacagccgtggattttggcaactcctatatcgctgagatggaaaccgagagctggattgttgaccgccaatgggcccaggatctcacgctgccttggcagtccgggtctggaggcgtgtggcgggagatgcaccatctggtcgagttcgagccccctcacgccgctacaatcagagtgctcgccctggggaatcaagaaggaagccttaaaaccgcgctgaccggcgctatgcgcgttacaaaggacaccaacgataataacctctacaagctgcatgggggccacgtgtcctgccgggtcaaacttagcgccctgacactcaagggaacgtcttataaaatttgtaccgacaagatgtttttcgtgaaaaatcccacagataccggccacgggacagtggttatgcaggtcaaggtgtccaagggagccccgtgcagaatccctgtgatcgtcgctgacgacctgaccgccgctattaacaaaggcatcctggtgacggttaatcccattgccagcaccaacgatgacgaggtgctcatcgaagtcaatcctcccttcggggattcttacattatcgtgggacgcggcgacagccggctgacatatcagtggcataaggaggggtcctctatcggcaaactttttacccagacaatgaagggagttgagagactggcggtgatgggcgataccgcctgggacttcagctccgctgggggatttttcacgagcgtcggcaaagggattcacacagtgtttggatctgccttccaaggcctctttgggggcctgaactggatcaccaaggttattatgggagctgtgctgatctgggtcggcattaatacacgcaacatgaccatgtccatgagcatgatccttgtgggggtgattatgatgttcctctctctgggagtcggcgcc

SEQ ID NO: 284 - RNA, 3081 nt, synthetic construct
  misc_feature 1..3081: note = derived and/or modified CDS sequence (opt5) from YFV 17D__NC_002031.1__SS-prME-NS1
  source 1..3081: mol_type = other RNA
gacgtgctgaccgtccagttcctcatcctgggcatgcttctgatgacagggggagttacgctcgtgagaaagaaccggtggctgcttctgaatgtgaccagcgaggatctcggcaaaacattttccgtcgggaccggaaactgcacaaccaatattctggaagccaagtactggtgtcccgactctatggagtataactgccctaatctgagcccgcgcgaagaacccgatgacatcgattgttggtgctacggcgtggaaaacgttagagtggcttatgggaaatgtgactccgccggacggtctcgcagaagccggcgcgcgattgatctccctacacacgagaatcatggcctgaagaccagacaagagaaatggatgacgggccggatgggggaacgccagcttcagaagatcgagagatggttcgtccggaacccctttttcgctgtgaccgccctgacaattgcctacctcgttggatccaatatgacccagcgcgtggtcatcgctctgcttgtgctggccgtgggccctgcttattctgcccactgcatcgggattacagacagagattttatcgaaggagtccatggcgggacctgggttagcgcgacgctcgagcaagacaagtgtgtgacagtgatggcccccgataaaccttccctggacattagcctggagaccgtcgctatcgatcggccggccgaagtgcgcaaggtttgctacaacgctgtgctcacacacgtcaaaattaatgacaagtgtccctctaccggagaggcccatctggcggaagagaacgaaggcgacaatgcctgcaaaagaacctattccgatcggggctgggggaacggatgtggccttttcgggaagggaagcatcgtggcttgcgccaagtttacatgcgctaaatctatgtccctgttcgaggttgaccagacgaagattcagtacgtgatcagagcccagctccacgtcggcgccaaacaagagaattggaacaccgatatcaagacactgaaatttgacgctcttagcgggtctcaggaagtggagttcattggatacggcaaggcgaccctggaatgtcaggtccagacagccgtggattttggcaactcctatatcgctgagatggaaaccgagagctggattgttgaccgccaatgggcccaggatctcacgctgccttggcagtccgggtctggaggcgtgtggcgggagatgcaccatctggtcgagttcgagccccctcacgccgctacaatcagagtgctcgccctggggaatcaagaaggaagccttaaaaccgcgctgaccggcgctatgcgcgttacaaaggacaccaacgataataacctctacaagctgcatgggggccacgtgtcctgccgggtcaaacttagcgccctgacactcaagggaacgtcttataaaatttgtaccgacaagatgtttttcgtgaaaaatcccacagataccggccacgggacagtggttatgcaggtcaaggtgtccaagggagccccgtgcagaatccctgtgatcgtcgctgacgacctgaccgccgctattaacaaaggcatcctggtgacggttaatcccattgccagcaccaacgatgacgaggtgctcatcgaagtcaatcctcccttcggggattcttacattatcgtgggacgcggcgacagccggctgacatatcagtggcataaggaggggtcctctatcggcaaactttttacccagacaatgaagggagttgagagactggcggtgatgggcgataccgcctgggacttcagctccgctgggggatttttcacgagcgtcggcaaagggattcacacagtgtttggatctgccttccaaggcctctttgggggcctgaactggatcaccaaggttattatgggagctgtgctgatctgggtcggcattaatacacgcaacatgaccatgtccatgagcatgatccttgtgggggtgattatgatgttcctctctctgggagtcggcgccgatcaggggtgtgcgatcaattttggaaagcgggaactgaaatgcggcgacgggatcttcatttttagagattccgacgattggctcaacaagtacagctattaccccgaggaccctgttaaactggcctccatcgtgaaggcttctttcgaagagggcaaatgtggacttaatagcgtggattccctggagcatgaaatgtggcgctctcgggccgacgagattaacgctatctttgaagagaacgaagtcgacattagcgtggttgtgcaggatccgaagaatgtctaccagagaggcacccaccccttctcccggatccgcgacgggctccaatatggatggaagacatggggcaaaaacctggtgttcagccctgggagaaagaatggatcttttatcattgatggcaaatcccggaaggagtgccccttcagcaacagagtttggaactcttttcagatcgaggagttcggcacgggggtgtttaccacacgcgtctacatggacgccgtgttcgaatataccattgattgtgacggatccatcctgggcgccgctgttaatgggaaaaagagcgcgcatggatctcctacattttggatgggcagccacgaagtgaatgggacctggatgattcacacgcttgaggccctcgattacaaagaatgcgagtggcccctgacacataccatcggaacctccgtcgaggaaagcgagatgttcatgccgcggtctatcggcggccctgtgtccagccacaaccatattcccgggtataaggtgcagacaaatggaccttggatgcaggtccccctggaagttaagagagaggcttgtcctggcacctccgtgatcattgacgggaactgcgatggacgcggcaaatctacaagaagcacgaccgactccgggaaggtgatccccgaatggtgctgtcggtcttgcacaatgccgcctgtcagctttcacggatccgatggctgttggtaccccatggagattcgccccagaaaaacccacgagtctcatctcgtgcggagctgggttacagcc

SEQ ID NO: 285 - RNA, 273 nt, synthetic construct
  misc_feature 1..273: note = derived and/or modified CDS sequence (opt5) from YFV 17D__NC_002031.1__C (without X-SS)
  source 1..273: mol_type = other RNA
atgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctc

SEQ ID NO: 286 - RNA, 1026 nt, synthetic construct
  misc_feature 1..1026: note = derived and/or modified CDS sequence (opt5) from YFV 17D__NC_002031.1__NS1 (without XX)
  source 1..1026: mol_type = other RNA
agagagctgaagtgcggcgacgggatcttcatttttcgggatagcgacgattggctcaacaaatactcctattaccccgaagaccctgtgaagctggcctctatcgtcaaagctagcttcgaggaaggaaagtgtggccttaattccgttgattctctggagcacgaaatgtggcgcagcagagccgacgagattaacgcgatctttgaggaaaatgaggtggatatttccgtggtcgtgcaggacccgaaaaacgtttatcaacgggggacccatcccttctctcgcatcagagatggactccagtacggctggaagacatgggggaagaatctggtgtttagccctggacggaaaaacggctccttcatcattgacggcaagagccgcaaagaatgccccttttctaatagagtctggaactccttccagatcgaggagtttgggacgggagtgttcaccacacgggtttatatggatgctgtgtttgaatacaccattgactgtgatggcagcatccttggggccgccgtcaatggaaagaaatctgctcacggctcccctacattctggatggggagccatgaggtgaacggaacctggatgattcacacactggaagccctcgactataaggagtgcgaatggcccctgacccatacgatcggcacctctgtggaggagtccgaaatgtttatgcctcgcagcattggcgggccggtctcctctcacaatcacatccccggatacaaggttcagacaaacggcccttggatgcaagtgcccctggaggtgaaaagagaggcttgtcctgggaccagcgtcatcattgacggaaattgcgatggccgggggaagtccacacgcagcaccacggactctggaaaagtgatccccgaatggtgttgcagatcctgtacaatgccgcctgttagcttccatggctctgatggctgctggtaccccatggaaattcggcctcgcaagacccacgagagccatctcgtgagatcctgggtcacagcc

SEQ ID NO: 287 - RNA, 10233 nt, synthetic construct
  misc_feature 1..10233: note = derived and/or modified CDS sequence (opt6) from YFV 17D__NC_002031.1__polyprotein
  source 1..10233: mol_type = other RNA
atgtcaggaagaaaagcacaaggaaaaaccttgggtgttaatatggtacgccgtggagtgagaagcctaagcaataaaattaaacagaaaactaaacaaattggaaacaggccggggcctagcagaggggtgcaaggttttatcttcttcttcttatttaatatcttgaccggtaagaaaataaccgcacatttaaaaaggttgtggaaaatgctagatccaaggcaaggtttagctgttttacgtaaagtcaaaagagtagtggcgagtctaatgcgtggattaagctctaggaaacgtcgatcacatgatgtgctaacagtccaattccttatcctaggtatgcttcttatgactggaggagttaccctggtaaggaaaaatcgatggttgttgctaaatgtaaccagcgaagaccttggaaaaacgttttcagtaggtacagggaactgcacaacgaatatactagaagcaaaatattggtgtcccgattctatggaatacaattgtccaaacctgtccccaagggaagaaccggatgatatagactgctggtgttacggagtggaaaacgttcgcgttgcgtatggaaaatgcgactctgctggaagaagcaggcgatcgcgtagagcaattgacctgccaacacatgaaaatcatggattaaaaacaagacaggaaaaatggatgacaggaaggatgggagaacgtcaattacagaaaatcgaacgatggtttgttcgaaatcctttctttgcagttacggcattaactatagcgtatttagtaggatcaaatatgactcaacgagtagtaatagctctattggtccttgcagttggaccagcctactcagcgcattgcataggaataacggaccgcgatttcatcgaaggagtgcatgggggaacttgggttagtgccactctagaacaagacaaatgtgtaaccgtaatggcgcccgacaaaccaagtcttgacatatcattggaaacagtagcaatcgatcgtccagcagaagtacgtaaagtttgctataatgcagtcctcactcacgtcaaaataaatgataaatgtccatcaacaggagaagcgcatctggctgaagaaaatgagggcgacaatgcttgcaaacgaacctatagtgatcgaggatggggtaatggctgcggtctttttggcaaagggtccatagtagcatgcgcgaaatttacatgtgctaaaagtatgagtctattcgaagttgaccaaacaaaaatccaatacgtaattcgagcccaattacacgtaggagctaaacaggaaaattggaacaccgatataaaaacgctcaaatttgatgcactatctggaagtcaagaagtcgaatttataggttacggtaaagcaacactagaatgtcaagttcagacagcagtcgacttcggaaattcttacatagccgaaatggaaacagaatcttggatcgtagatagacaatgggcacaggatctaaccttaccttggcaatcggggtcaggtggcgtttggcgagaaatgcaccatcttgtagagttcgaaccaccacacgctgctaccattcgagtattggccctaggaaaccaggaagggagtcttaagaccgcattaactggcgcaatgcgagtaacaaaggatactaatgataataacctttataaactacatggtgggcacgtatcatgtagagtgaaacttagtgcactcacactcaaaggaacgtcttataaaatttgcacagacaaaatgttctttgtgaaaaatcccacagacactggacatggtacagtagtaatgcaagtaaaagtatcaaaaggagccccatgcagaatacctgtaatagtagcagacgatcttacagcagccatcaataaaggtatactggtcactgtaaatccaatagcgagtacgaatgacgatgaagttttgatagaagtgaatccaccattcggcgactcatatattattgtgggtagaggagactcaagactaacttaccagtggcataaagaaggaagcagcataggaaagctgtttacgcaaactatgaaaggagtagaaaggttggcagtaatgggggataccgcttgggactttagttcagccggcggattcttcacgtcagtaggaaaaggcatacatacagtttttggatccgcctttcaaggactctttgggggcttaaactggataacgaaggtaataatgggagctgttttgatctgggtagggataaatacgcgcaacatgactatgagtatgagcatgatattagttggtgttataatgatgttcttaagccttggggtcggcgctgatcaaggttgtgctattaatttcggaaagagagaacttaagtgcggagatggaatatttatattcagagattcggacgactggctgaataaatactcatattaccccgaagaccctgtaaaactggccagcatcgtcaaagcgagctttgaagaaggtaaatgtggtcttaattcagtagactcgctcgaacacgaaatgtggcgatcacgagcagatgaaataaatgctatcttcgaagaaaatgaagtagatatcagcgttgttgtacaggatccgaagaatgtataccagcgagggacccatccattctctcgaatcagagatggtttacaatacggttggaaaacatggggcaaaaatctagtattcagcccgggaaggaaaaacggcagctttattatagacggcaaatcaaggaaagaatgccctttttctaatagagtatggaacagtttccaaatcgaagaatttggcacgggtgtatttacaacccgggtttatatggacgcagtttttgaatacacaatagactgcgacggttctatacttggtgcagcagtaaatggcaagaaaagcgcacacggatcccccacgttttggatgggatcgcatgaagtaaatggtacatggatgatccatacactagaggctttagattataaggaatgtgagtggcctcttacacacactataggaacatctgtagaggaaagcgagatgttcatgccccgcagtatcggagggccagtcagttcacataatcacatcccgggatataaagttcaaacaaatggaccatggatgcaagtaccactagaagtaaagcgagaggcttgtcccggtacgtctgtaattattgatggtaactgtgacggaaggggaaaatcaacaagaagtactaccgattccggaaaagtaattccagagtggtgctgtagatcgtgtacaatgccaccggtctcatttcacgggagtgatggatgttggtatccaatggaaatacgaccgagaaaaactcacgaaagtcacctagtgaggtcgtgggttacggctggcgaaatacacgctgtacctttcggacttgtctctatgatgatagcaatggaggtggtacttcgcaagcgccagggtcccaaacaaatgttagtaggtggcgtcgtgctattaggtgcaatgctagtcgggcaagttacactactggatttattgaaactcacagttgctgtaggtcttcatttccatgaaatgaataatggtggagacgctatgtacatggcactaattgctgctttctcaataaggcctggtttactaattggcttcggactcagaactctatggtcgccgagggagaggctggtcctaactctcggcgcggccatggtagagattgcactaggaggagttatgggcggactctggaaatatctgaatgctgtttcattgtgcattttaaccatcaatgctgtagcatcccggaaagccagtaatacaattctcccacttatggcattacttaccccggtaactatggccgaagtaagactggcagcaatgttcttttgtgcagtcgtaatcataggggttttacaccaaaattttaaggacacgtcaatgcaaaagacaatccctctagtcgctctaaccctaacatcttatctcggattaacgcaaccatttttaggtttatgtgcgttcttagcgaccagaatcttcggtagacgatcaattccagtcaatgaggctctggccgcggccggacttgtcggcgtattagcagggttagcattccaggaaatggaaaattttctaggtcctatcgccgtcggtgggctactaatgatgttagtaagcgttgcaggaagggtcgacggtttagagttgaagaaattaggggaagtatcttgggaagaagaggcggaaatatcaggatcttctgcaagatatgatgtcgctttatccgaacaaggcgagtttaaactacttagcgaagaaaaagttccatgggatcaagtagtaatgacgagccttgccttagtaggagcagctttacatccatttgcattactcttggtcttagcgggatggctgtttcacgtaagaggagcgagacgttcaggtgacgtactttgggacataccaactcccaaaatcatcgaagaatgcgaacacctggaagacggaatttacggaatattccaatcaacgtttttaggcgccagccaaaggggagtaggagtagcacaaggaggtgttttccacacaatgtggcatgttactagaggagcattccttgtgcgtaacggtaagaaattaattccgagctgggcaagcgtaaaagaagatctggttgcttacggaggatcatggaaacttgaagggcgatgggatggcgaagaggaagtgcaacttattgcagctgttcccggcaaaaatgtggtaaacgtgcaaaccaaaccttcgttatttaaagttcggaatggaggagaaataggagcagtcgccctcgattatccatcgggaacaagcggaagccctatagttaatcgaaatggagaagtcatagggctatatggaaatggtattttagtgggagataacagttttgtttcagcaattagccaaaccgaagttaaagaagaagggaaagaagaattacaggaaattcccactatgctcaagaaagggatgactacagtccttgactttcatccaggtgccgggaaaacacggcgctttttaccccaaatactcgcagaatgtgcgaggagacggttaaggacattggtgcttgcaccgactcgagtagtactaagcgaaatgaaagaggctttccacgggttagacgtcaaattccatacccaggcattttcggcacacggtagtggaagagaagtaattgatgccatgtgtcatgctacattaacctacaggatgttagaaccaacgcgcgtggtaaactgggaagttataattatggacgaagcgcactttttggacccagcttcgatcgcagcgagaggttgggcagcgcacagagctcgtgcaaacgagtcagccactattctaatgacagcaacacccccaggaacaagcgatgagttcccacattctaacggcgaaatagaagatgttcaaactgatataccctcggaaccatggaacacagggcatgattggattttggccgacaaacgacctacagcatggttcttaccgtcaattagagccgcaaacgtcatggcagccagcttgagaaaggctggtaaaagtgtggtcgtcctgaaccgcaagaccttcgagagagaatatcccaccattaaacaaaagaaacctgactttattcttgcgactgatatagcagaaatgggagccaacctctgcgtagaaagagttctagactgcaggacagcgtttaaacccgtgcttgttgatgaaggaaggaaagtagcaataaaaggaccactgcgaatctctgcttcctccgcagcacaaaggcgcggacgcatagggagaaaccctaatcgagacggagatagctattattatagtgaaccgacaagtgaaaacaatgcacaccatgtatgttggctcgaggctagtatgttattggacaatatggaagttagaggtggtatggttgcgccactgtacggagtagagggcacaaaaacacctgtatccccaggggaaatgagattgcgagacgaccaacggaaagtattcagagagctagtacgaaattgcgatcttccagtatggttaagttggcaagtcgctaaagcaggtctaaagaccaacgaccggaagtggtgttttgagggcccagaagaacatgaaatacttaatgacagcggtgaaacggtaaaatgccgtgcacctggtggagctaagaaaccactacgacccagatggtgtgatgaaagggtaagttccgatcagtctgccctgtctgaatttattaagtttgccgagggaagacggggagccgctgaagtattggtcgtattgtcggaattacctgactttttggcgaagaaaggaggagaagcgatggatacgatctctgtattcctacacagtgaagagggaagcagggcataccgcaacgcgttaagtatgatgcctgaagcaatgaccatagtaatgttatttatcttagctggtttactaacgagcggtatggtaatatttttcatgagcccaaaaggcataagcagaatgagcatggcaatgggaactatggcaggttgtggctatttaatgtttctaggtggcgttaaaccaacacatatctcttatgtaatgctaatattcttcgttctcatggtggttgtaataccggaaccaggccaacaaagatccatacaagataaccaagttgcatacctcatcatagggatattaacattggtatcagcagtagcggcaaatgaacttgggatgctggagaagacaaaagaagacctgtttggcaagaaaaatctaattccctcgtccgcatccccgtggagctggccagacttggacttaaaacccggtgctgcttggactgtgtatgtaggaattgtaacaatgttgtcccctatgttacatcattggataaaagttgaatatggtaacctaagtttatcagggattgctcaatccgcatctgttctctcatttatggataaggggataccatttatgaaaatgaacatatcggtaatcatgcttctcgttagcggttggaatagtataactgttatgccattattgtgtggcattggatgcgcaatgctccattggagcttaatacttcccggaataaaagcacaacaatctaaactggcgcagcgtcgagtattccatggcgtcgcagaaaatcctgtggttgacggaaacccgacggtggatatcgaagaagcaccggagatgcctgcactatacgagaagaaattagcactatatctgctacttgcactgagcctagcaagtgtggccatgtgtcggactccgtttagcctggcagagggaatcgtgttagctagcgcagcactcggtccacttatagaggggaatacgtcgcttctctggaatggacctatggctgtttccatgaccggcgtgatgagaggtaaccattacgcttttgtaggagtaatgtataacctttggaagatgaaaacggggcgccgtgggagtgcaaatggaaaaacactcggggaagtatggaaaagggagctgaatttactagataaacggcaattcgaactctacaaaagaacagacatagtagaagtagatagagatacagccagacgacatcttgcagaaggaaaagtagacacaggtgtagcagtgtcccgaggaacagcaaaacttcgctggtttcatgagcgaggttatgtcaaactagaaggacgggtgatagacctggggtgtggcaggggaggatggtgttattatgcagcggcacaaaaagaggttagtggagttaagggctttaccttggggcgagatggtcatgaaaagccaatgaatgtgcagtctttgggatggaacataataacattcaaagacaaaacagatattcacagattagaaccagtaaagtgtgatacattactatgtgatataggcgaaagtagctcatcgtcagtaacggaaggagaaagaacagtaagagtattagacacagttgaaaaatggctagcatgcggagtagataacttctgtgtcaaggtactcgcaccttacatgccagacgtactagaaaaactcgaactattacagcgaagatttggaggcaccgtcatacgtaacccacttagtagaaatagtacacatgagatgtactatgtttcaggcgctagatcaaatgtaacgtttacagtaaatcaaacatcgagactgcttatgcgacgaatgagaagacccaccggcaaagtcactttagaagcggacgtgattctacctattgggacccgatccgtagaaacagacaaaggtccattagacaaggaagctatcgaagagagagttgaacgcatcaagtcggaatacatgacatcttggttctatgataatgataatccctatcgtacttggcattactgtgggtcttatgtcacaaagacgagcggatctgcagctagtatggtaaacggggttataaagatattaacttatccgtgggatcgcatcgaagaagtcacgcgtatggctatgacggataccactccatttggacaacagagagtatttaaagaaaaagtagacacccgtgcaaaagatcctcctgctggcacgaggaaaataatgaaagtagtcaaccgatggctttttcgacatttggcacgcgagaaaaaccctaggttatgtacaaaagaagaatttattgccaaagtacgatcgcacgccgcaataggtgcatacctcgaggaacaagagcaatggaagactgcaaatgaggctgttcaagatccaaagttttgggagctcgtagatgaagagagaaaactacatcaacaaggcagatgtaggacatgtgtatacaacatgatggggaaacgtgaaaagaaactgagcgagttcggcaaagctaaaggtagcagggcgatatggtatatgtggctgggcgctagatatctagagttcgaagcactaggatttttgaatgaggaccactgggctagtcgagaaaattctgggggtggtgtggaaggaataggtttacaatatttaggctacgtaataagagatctcgcggctatggatggaggaggattttatgccgatgataccgctggatgggacacaagaataacagaagccgatcttgacgacgaacaagaaatcctcaattacatgagtcctcaccacaagaaacttgcacaagctgttatggaaatgacatacaaaaacaaggtagttaaagtccttcgaccagcacccggaggtaaagcatacatggacgtgatttcacggagagatcaacgtggctctgggcaagtagtgacttacgcactaaataccataaccaatttaaaggttcagctgattagaatggcagaagcagaaatggttattcaccatcaacacgttcaagattgcgatgaatctgtattgacgaggttggaggcttggttaacagaacatggttgtgatagattaaaaaggatggcagtatctggagatgattgtgttgtaaggccaatagatgatcgatttgggctagctttaagccatctgaacgctatgtcaaaagtccgaaaggatataagcgaatggcaaccatcaaaaggatggaatgactgggaaaacgtacctttttgttcacatcacttccatgagttacaactaaaagacggtcgacgaattgtcgtaccatgtagagagcaagacgaattaataggcagaggaagggtttcaccgggtaatggttggatgatcaaagaaacggcgtgtttatcaaaggcatacgctaatatgtggtctctaatgtatttccataaacgggacatgagattgctatctcttgcagtatcatcagccgtcccaacttcatgggtgccacaaggtaggacaacatggtcgattcatggaaaaggagagtggatgactacggaagatatgttagaagtatggaatagagtatggataactaacaatccacatatgcaggataagactatggtcaagaaatggcgtgatgttccgtaccttaccaaaaggcaggacaaactatgtggaagtttaataggaatgacaaatcgtgccacatgggcctcgcacattcacctggttattcatagaattagaactttaatagggcaagaaaagtacactgactatttgaccgtcatggacagatattccgtcgacgcagacctgcaactaggtgagttaatt

SEQ ID NO: 288 - RNA, 303 nt, synthetic construct
  misc_feature 1..303: note = derived and/or modified CDS sequence (opt6) from YFV 17D__NC_002031.1__C
  source 1..303: mol_type = other RNA
atgagtggaagaaaagcacaaggaaaaacattaggagtaaacatggtaagaagaggagtaagaagcctaagcaacaaaataaaacaaaaaacaaaacaaataggaaacagaccaggaccaagcagaggagtacaaggattcatattcttcttcctattcaatatactaacaggaaaaaaaataacagcacacctaaaaagactatggaaaatgctagacccaagacaaggactagcagtactaagaaaagtaaaaagagtagtagctagcttaatgagaggactaagcagcagaaaaagaaga

SEQ ID NO: 289 - RNA, 363 nt, synthetic construct
  misc_feature 1..363: note = derived and/or modified CDS sequence (opt6) from YFV 17D__NC_002031.1__C-ER anchor
  source 1..363: mol_type = other RNA
atgagcggaagaaaagcacaaggaaaaacactaggagtaaacatggtaagaagaggagtaagaagcctaagcaacaaaataaaacaaaaaacaaaacaaataggaaacagaccaggaccaagcagaggagtacaaggattcatattcttcttcttattcaacatattaacaggaaaaaaaataacagcacacttaaaaagattatggaaaatgttagacccaagacaaggactagcagtattaagaaaagtaaaaagagtagtagcaagtctaatgagaggactaagcagcagaaaaagaagaagccacgacgtactaacagtacaattcctaatactaggaatgctactaatgacaggagga

SEQ ID NO: 290 - RNA, 267 nt, synthetic construct
  misc_feature 1..267: note = derived and/or modified CDS sequence (opt6) from YFV 17D__NC_002031.1__pr
  source 1..267: mol_type = other RNA
gtaacattagtaagaaaaaatagatggctattattaaatgtaacaagtgaagacttaggaaaaacatttagtgtaggaacaggaaattgtacaacaaatatattagaagcaaaatattggtgtccagatagtatggaatataactgtccaaatttaagtccaagagaagaaccagatgacatagactgttggtgttacggagtagaaaatgtaagagtagcatatggaaaatgtgatagtgcaggaagaagcagaagaagtagaaga

SEQ ID NO: 291 - RNA, 225 nt, synthetic construct
  misc_feature 1..225: note = derived and/or modified CDS sequence (opt6) from YFV 17D__NC_002031.1__M
  source 1..225: mol_type = other RNA
gcaatagacctaccaacacacgaaaaccacggactaaaaacaagacaagaaaaatggatgacaggaagaatgggagaaagacaactacaaaaaatagaaagatggttcgtaagaaacccattcttcgcagtaacagcactaacaatagcatacctagtaggatcaaacatgacacaaagagtagtaatagcactacttgtactagcagtaggaccagcatactca

SEQ ID NO: 292 - RNA, 492 nt, synthetic construct
  misc_feature 1..492: note = derived and/or modified CDS sequence (opt6) from YFV 17D__NC_002031.1__prM
  source 1..492: mol_type = other RNA
gtaacattagtaagaaaaaataggtggttattattaaatgtaacaagtgaagatttaggaaaaacatttagtgtaggaacaggaaattgtacaacaaatatattagaagcaaaatattggtgcccagatagtatggaatataattgtccaaatttaagtccaagagaagaaccagatgatatagattgttggtgttatggagtagaaaatgtaagagtagcatatggaaaatgtgatagtgcaggaagaagtagaagaagtaggagagcaatagatctaccaacacatgaaaatcatggactaaaaacaagacaagaaaaatggatgacaggaaggatgggagaaagacaattacaaaaaatagaaagatggtttgtaagaaatccattttttgcagtaacagcattaacaatagcatatctagtaggaagtaatatgacacaaagagtagtaatagcattattagtattagcagtagggccagcatatagt

SEQ ID NO: 293 - RNA, 1479 nt, synthetic construct
  misc_feature 1..1479: note = derived and/or modified CDS sequence (opt6) from YFV 17D__NC_002031.1__E
  source 1..1479: mol_type = other RNA
gcacactgtatagggataacagatagggattttatagaaggagtacatggaggaacatgggtaagcgcaacactagaacaagataaatgcgtaacagtaatggcaccagataaacctagcttggatataagtttagaaacagtagcaatagatagacccgcagaagtaaggaaagtatgttataacgcagtacttacacatgttaaaataaatgataagtgcccaagtacaggagaagcacatctggcagaagaaaatgaaggagataatgcatgtaaacgaacctactcagatagaggatggggaaacggatgcggattatttggaaaaggaagcatagtagcatgtgctaaatttacatgtgcaaaatcaatgtcattattcgaagtagatcaaacaaaaatacaatatgtaatcagggcacaactgcacgtaggtgcaaaacaagaaaattggaatacagatataaagacattgaaattcgatgcactttcaggaagtcaagaagtcgaatttataggttatggaaaagcaacattagaatgtcaagtacaaactgcagtagactttggaaattcatatatagcagaaatggaaacagaaagctggatagttgatagacaatgggcacaagacttaacattaccatggcaaagtggatcaggaggagtatggagagaaatgcatcatctagtagaatttgaacccccacatgctgcaactataagagtactagcattaggaaatcaagaaggatcattaaaaactgcactaacaggagcgatgcgagtaacaaaagatacgaacgataataatttatacaaattacatggaggacatgtaagctgtagggttaaacttagcgcattaactttaaaaggaacatcatataaaatttgtacagataaaatgttctttgttaaaaatccaacagacacaggacacggaacagtagtaatgcaagtaaaagtaagcaaaggagcaccatgcagaatccctgtaatcgtagcagatgatctaactgcagcaataaataaagggattctagtaacagtaaatcccatagcatcaacaaatgacgatgaagtattaatagaggtaaacccaccatttggtgacagttacataatagtaggtagaggagacagccggttaacatatcaatggcataaggaaggtagttcaattggtaagttattcacacaaacaatgaaaggagtggaaagactagctgtaatgggagatacagcatgggatttctcaagcgctggtggattctttacatcagtaggaaagggaatacatactgtttttgggagcgcatttcaaggactatttggaggactaaactggataacaaaagtaataatgggagcagtattaatatgggtagggataaatacaagaaacatgacaatgtcaatgtctatgatcctagttggagtaataatgatgtttttaagtttaggtgtaggtgca

SEQ ID NO: 294 - RNA, 1971 nt, synthetic construct
  misc_feature 1..1971: note = derived and/or modified CDS sequence (opt6) from YFV 17D__NC_002031.1__prME
  source 1..1971: mol_type = other RNA
gtaacattagtcagaaagaacagatggttattactgaacgtaacaagtgaagacttaggaaaaacatttagtgtaggcacaggaaattgcacaacaaatatacttgaagcaaaatattggtgtccagatagcatggaatataattgtccaaatttatcacctagagaggaacccgatgatatagattgttggtgttatggagttgaaaacgtgcgagtagcatatggtaaatgtgatagcgcaggaagaagtagaagaagtagaagggcaatagacttaccaactcatgaaaaccatggattaaaaacaagacaggaaaaatggatgacaggaagaatgggagaacgacaattacagaaaatagaaagatggttcgtaagaaatccattctttgcagtaacagcattaacaatagcatatctagttggaagtaacatgactcaaagagtagtaatagcattgttagtactagcagtaggaccggcttatagcgcacattgtatagggataacagatagagactttatagaaggagtgcacggtggaacatgggtttcagcaacgctagagcaagataaatgtgtaacggtaatggcgccggataaaccaagccttgacatatcactagaaacggttgcaatcgatcgaccagccgaagtaagaaaagtatgctataatgcggtcttaacacacgtaaaaataaatgataaatgtccttcaacgggagaagcacatttagcagaagaaaacgaaggagacaacgcgtgtaaaagaacatattcagataggggctggggaaacggctgcggtttatttggaaaaggaagtatagtagcatgcgcaaaatttacttgcgcaaaaagtatgagtttattcgaagttgatcaaacaaagatacaatatgtaatacgagcacaattacatgtaggtgcaaagcaagaaaattggaatacagacataaaaacattgaaatttgacgctttgagtggatcacaagaagtagaatttataggatacggaaaagctacattagaatgtcaagtacaaactgcagtagattttggaaattcgtatatagcagaaatggaaactgaatcatggattgtagataggcaatgggcacaagatttaaccttgccatggcaaagcggaagcgggggtgtatggcgggaaatgcatcatttagtagagttcgaacccccacacgcggctaccataagagtactagcattaggaaatcaagaagggagtctcaagacagcactcacaggtgcaatgcgagtaacgaaagatacaaatgacaataatctatacaaactacacggaggacatgtatcttgcagagtaaaattatctgcattaacactaaaagggacaagttacaaaatttgtacagataagatgttctttgtcaaaaacccaacagacacgggacacggaacggtagtcatgcaagttaaagtaagcaaaggagcgccatgcagaataccagtaatcgtcgcagatgatttaacagccgcaataaataaaggtatattagtaacggtaaatccaatagcgagtaccaatgatgatgaagtactaatagaagtgaacccaccatttggtgatagctatataatagtagggcgaggagattcaagattaacatatcaatggcataaagaaggtagtagtataggaaaattatttacacaaactatgaaaggcgtagaaagactagcagtcatgggagatacagcatgggatttctcaagtgcaggcggatttttcacaagcgtcggaaaaggaatacatacagtgtttggtagtgcgtttcaaggattattcggaggactaaattggataacgaaagtaattatgggagcagttctcatatgggtcggaataaatacaaggaacatgactatgagtatgagcatgatcctagtaggagtaataatgatgtttctaagcctaggcgttggtgca

SEQ ID NO: 295 - RNA, 2031 nt, synthetic construct
  misc_feature 1..2031: note = derived and/or modified CDS sequence (opt6) from YFV 17D__NC_002031.1__ER anchor-prME
  source 1..2031: mol_type = other RNA
agccatgatgttcttacagtacaattcttgatactcggaatgttgttaatgacaggaggagtgacattagtaaggaaaaacagatggttactactaaatgttactagcgaagatttaggaaaaacattcagcgtaggaacgggaaattgcacaactaacatattagaagcaaaatattggtgccctgattcaatggaatacaactgtcccaacttatctcctagagaagaacccgatgacatagattgttggtgttatggagtagaaaacgtgagagtagcttatggtaaatgcgacagcgcgggtcgaagtagaagaagtcgtagagctatagatctacctacacatgaaaatcacggacttaaaaccagacaagaaaaatggatgacaggaagaatgggagaaagacaattacagaaaatagaaagatggttcgtaagaaatccattctttgccgtgacagcattaacaatagcatatttagttggatctaacatgacacaaagagtagtaatagcccttctagtattagcagtaggcccggcatactcagcacattgtataggtataacagacagagattttatagagggagtacatggaggtacatgggtatcagcaacattggaacaagataaatgcgttacagtaatggctccagataaacccagtttggatataagtttagaaactgtagcaatagatcgaccagccgaggtcagaaaagtatgttataatgcagttttaacacatgtaaaaataaacgataagtgtccaagtacaggagaagcacatttagcagaagaaaacgaaggagataatgcttgcaaaagaacatattcagacagaggttggggaaacggatgtggattatttggaaaaggatcaattgtagcatgtgcaaaatttacatgcgcaaaaagtatgtctttatttgaagtagatcaaacaaaaatacaatatgttataagggcacaattgcacgtaggagcaaaacaagaaaactggaatacagatataaaaacactaaaatttgatgcactaagtggatcacaagaagtggaatttataggatacggaaaagcaactctagagtgccaagtccaaactgcagtagactttggaaatagttacattgcagaaatggaaacagaatcatggatagtagacagacaatgggcacaagatttaactttaccatggcaatcaggttcaggaggagtatggcgagagatgcatcaccttgttgaatttgagccgccccatgctgcaacaataagagtactcgcattaggaaatcaagagggttctttaaaaacagcattaacaggagccatgagagtaacaaaagatacaaatgataataatttatataaattacacggaggacatgtttcttgtagggtaaaactttcagcactaacacttaagggaacaagttataaaatatgtactgacaaaatgttctttgtcaaaaatccaacggatacggggcatggtacagtagtaatgcaagtaaaagtaagtaaaggagcaccatgcagaataccagtaatagtcgcagacgacctaacagctgccataaacaaaggcatactggtcacagtcaatcccatagcatcaactaacgacgatgaagtactaatagaagtaaacccaccttttggtgatagttatataatagtaggacgaggagattcacgactaacttatcaatggcataaagaagggtcatcaataggaaagttatttacacaaacaatgaaaggagtagaacgattagcagtcatgggagatacggcatgggattttagcagtgcagggggtttcttcacatcagtagggaaaggaatacacaccgtatttggttcagcatttcaaggactatttggaggattaaattggataactaaagtaataatgggtgcagtattaatatgggtcggaataaacacacgaaatatgacaatgtcaatgagtatgatattagttggcgtaataatgatgttcttatcattaggagtaggagca

SEQ ID NO: 296 - RNA, 1056 nt, synthetic construct
  misc_feature 1..1056: note = derived and/or modified CDS sequence (opt6) from YFV 17D__NC_002031.1__NS1
  source 1..1056: mol_type = other RNA
gatcaaggatgtgcaataaattttggaaaaagagaattaaaatgtggagatggaatattcatatttagagatagtgatgactggttaaataaatatagttattatccagaagatccagtaaaactagcgagtatagtaaaagcaagttttgaagaaggaaaatgtggattaaattcagtagacagcttagaacatgaaatgtggaggagtagagcagatgaaataaatgcaatattcgaagaaaatgaagtagatataagtgtagttgtacaagatccaaaaaatgtatatcaaaggggtacacatccatttagtagaataagagacggactacaatatggatggaaaacatggggaaaaaatttagtattttcaccaggaagaaaaaatggaagttttataatagatggaaaaagcaggaaagaatgtccttttagtaacagagtatggaatagctttcaaatagaagaatttggaacaggagttttcacaacgagagtatacatggatgcagtattcgaatatacaatagattgcgacggaagtatactaggagctgcagtaaatggaaaaaaatcagcacatggatcgccaacattctggatggggagtcacgaagtgaatggaacatggatgatacacacattagaagcactggattataaagaatgtgaatggccattaacgcatacaattgggacaagtgtagaagaatcagaaatgttcatgccgaggtcaattggaggacccgtaagctcacataatcatataccaggatataaagtacagacaaatggaccatggatgcaagtaccattagaagtaaaaagagaagcatgtccaggaacaagcgtaataatagatggaaactgtgatggtagaggaaaaagtacaagaagtacgacagatagcggaaaagtaataccagaatggtgttgtagatcgtgtacaatgccaccagttagcttccacggaagcgatggatgttggtatccaatggaaataagaccaagaaaaacacatgaatcacatttagtaagatcatgggtaacagca

SEQ ID NO: 297 - RNA, 672 nt, synthetic construct
  misc_feature 1..672: note = derived and/or modified CDS sequence (opt6) from YFV 17D__NC_002031.1__NS2A
  source 1..672: mol_type = other RNA
ggcgaaatacatgccgtaccatttggacttgtatcaatgatgatagcgatggaagtagtattaagaaaaagacaaggaccaaaacaaatgctagtaggaggagtagtattattaggagcaatgttagtaggacaagtaacattactagatctattaaaattaacagtggcagtaggattacactttcatgaaatgaataacggaggagatgcaatgtacatggccttaatagcagcatttagcataagaccaggattattaataggctttggcctacgaacactatggagcccaagagaacgacttgtcttaacattaggtgcagctatggtagaaatagcactaggaggagtaatgggaggattgtggaaatatttaaacgcagtatcattatgtatattaacaataaatgcagtagcaagcagaaaagcaagcaatacaatattaccgttaatggcattactaacaccagtaacaatggcagaagtaagattagcagcaatgtttttttgcgcagtagtaataataggagtattacatcaaaatttcaaagacacaagtatgcaaaaaacaatacccttagtagcactaacactaacaagttatctaggactaacacaaccattcttaggattatgcgcattcttagcaacaagaatatttggaagaaga

SEQ ID NO: 298 - RNA, 390 nt, synthetic construct
  misc_feature 1..390: note = derived and/or modified CDS sequence (opt6) from YFV 17D__NC_002031.1__NS2B
  source 1..390: mol_type = other RNA
agtataccagtaaacgaagcattagcagcagcaggattagtaggagtattagcaggattagcatttcaagaaatggaaaattttttaggaccaatagcagtaggaggattattaatgatgttagtaagtgtagcaggaagagtagatggattagaattaaaaaaattaggagaagtaagttgggaagaagaagcagaaataagtggaagtagtgcaagatatgatgtagcattaagtgaacaaggagaatttaaattattaagtgaagaaaaagtaccatgggatcaagtagtaatgactagcttagcgttagtaggagcagcattacatccatttgcattattattagtattagcaggatggttatttcatgtaagaggagcaagaaga

SEQ ID NO: 299 - RNA, 1869 nt, synthetic construct
  misc_feature 1..1869: note = derived and/or modified CDS sequence (opt6) from YFV 17D__NC_002031.1__NS3
  source 1..1869: mol_type = other RNA
agtggtgatgtcctatgggacataccaacacctaaaattatagaagaatgtgagcatttggaagacggaatatatggaatatttcaaagtacatttctaggcgcaagtcaaaggggagtcggagtagcacaaggaggtgtatttcatacgatgtggcacgtaacaagaggagcgtttttagtaaggaatggaaagaaattgataccaagctgggcctcagtgaaagaagatttagtagcatatggaggatcatggaaattagaaggaagatgggacggagaagaagaagtacaattaattgcagcagtacctggcaaaaatgtagtaaatgtacaaaccaaacctagtttatttaaagtaagaaatggaggagaaataggagcagtggcgctagattatccatcaggtacaagtgggtcacctatagtaaatagaaatggagaggtaataggattgtatggtaacggaatattagttggagataatagtttcgttagtgcaataagtcaaacggaagtgaaagaagagggaaaagaagaactacaagaaataccaactatgctaaagaaaggaatgacaacagtattggacttccatccgggagcaggaaaaacaagaagatttttaccacaaatattagctgaatgcgctaggagaagactaagaacactggttttagctccaacaagggtggtactaagcgaaatgaaagaagcctttcatggactagatgtaaaatttcatactcaggcattctcggctcatggatcaggacgcgaagtaatagacgctatgtgtcatgcaacattaacatatagaatgctagaaccaactagagtagtaaactgggaagtaataataatggacgaagcacatttcctagaccctgcgagtatagcagcaagaggttgggcagcacacagagctagagcgaatgaaagtgcaacaatactaatgacagcaacaccaccaggaacgagtgacgaatttccacacagtaatggagaaatagaggatgtacaaactgatattcccagtgaaccatggaatacaggtcatgattggatactagcagataaaagaccaacagcttggttcttaccaagtataagagcagcaaatgttatggcagcatcattaaggaaagctggaaaaagtgtggtagtgttaaacaggaagactttcgaaagagaatatcctacgataaaacaaaagaaacctgattttatacttgcaacagatattgcagaaatgggagctaacttatgcgtagagagagtacttgattgtagaactgcatttaaaccagtgctagtagacgaagggagaaaggtagcaataaaaggacccttaagaatcagtgcctcatcagcagcacaaagacgtggtaggataggaaggaacccaaatagagatggtgattcatactattatagtgagccaacatcagaaaataacgcacatcacgtatgttggttagaagcaagcatgctccttgataatatggaagtaagaggaggtatggtggcaccattatacggggttgaagggacgaaaacgccagtcagtccgggtgaaatgagattaagagatgatcaaagaaaggtattcagagaattagttagaaattgtgatctgccagtttggctaagttggcaagtagcaaaagcaggattaaagacaaatgatagaaaatggtgtttcgaaggacctgaagaacacgaaatacttaatgatagtggtgaaacagtaaaatgtagagcaccaggtggagctaagaaaccgctcaggccaagatggtgtgatgaaagagtatcaagtgatcaatcagctctcagtgaatttataaaatttgcagaaggaaggaga

SEQ ID NO: 300 - RNA, 447 nt, synthetic construct
  misc_feature 1..447: note = derived and/or modified CDS sequence (opt6) from YFV 17D__NC_002031.1__NS4A-P2K
  source 1..447: mol_type = other RNA
ggagcagcagaagtattagtagtactatcagaactaccagactttttagcaaaaaaaggaggagaagcaatggatacaatatcagtattcttacattcagaagaaggaagcagagcatacagaaatgcattatcaatgatgccagaagcaatgacaatagtaatgttatttatattagcaggattattaacatcaggaatggtaatattctttatgtcaccaaaaggaataagcagaatgtcaatggcaatgggaacaatggcaggatgcggatatttaatgtttttaggaggagtaaaaccaacacatatatcatacgtaatgttaatatttttcgtactaatggtagtagtaataccagaaccaggacaacaaagatcaatacaagacaatcaagtagcatatttaataataggaatattaacattagtatcagcagtagcagca

SEQ ID NO: 301 - RNA, 750 nt, synthetic construct
  misc_feature 1..750: note = derived and/or modified CDS sequence (opt6) from YFV 17D__NC_002031.1__NS4B
  source 1..750: mol_type = other RNA
aatgaattaggaatgttagaaaaaacaaaagaagacttatttggtaaaaaaaatttaataccatcatcagcaagcccatggtcatggccagatctagacttaaaaccaggagcagcatggacagtatatgtaggaatagtaacaatgttatcaccaatgctacaccattggataaaagtagaatatggaaatttatcattatcaggaatagcacaatcagcatcagtattatcatttatggacaaaggaataccatttatgaaaatgaatatatcagtaataatgctattagtatctggatggaactctataacagtaatgccattactatgcggaataggatgcgcaatgttacactggtcactaatactaccaggaattaaagcacaacaatcaaaactagcacaaaggcgagtttttcacggagtagcagaaaatccagtagtagacggcaacccaacagtagatatagaagaagcaccagaaatgccagcattatatgaaaagaaattagcactttatttattattagcactttcattagcatcagtagcaatgtgcagaacaccattttcattagcagaaggaatagttttagcaagtgcagcattaggaccattaatagaaggcaatacatcattattatggaatggaccaatggcagtaagcatgacaggagtaatgcgaggaaatcattatgcatttgtaggagtaatgtataatctatggaaaatgaaaacaggaagaaga

SEQ ID NO: 302 - RNA, 2715 nt, synthetic construct
  misc_feature 1..2715: note = derived and/or modified CDS sequence (opt6) from YFV 17D__NC_002031.1__NS5
  source 1..2715: mol_type = other RNA
ggatcagcaaatggtaaaaccctaggtgaggtttggaaaagggaattaaatttgcttgataaaagacagttcgaactttataagagaactgatatagtagaagttgacagggacaccgcaaggagacatttagcagagggtaaggtagatacaggagtagcagtaagtcgtggaacagctaaactacgatggtttcatgagagaggatacgtaaaactagaaggaagggtaatagatttaggatgcggtagagggggatggtgttactacgcagcggcacaaaaggaagtgtcaggagtaaaggggttcacattaggaagggacggtcacgaaaaaccaatgaacgtacaatcgttaggttggaatataataacatttaaagataagacggacatccatcgactagaaccagtaaaatgtgatacactactctgtgatataggagaaagttcaagttcaagtgtaaccgaaggagaacgaacagtaagagtattagacaccgtagaaaagtggttggcatgtggagtagataatttctgtgtaaaagtgcttgcaccatacatgcccgatgtattagaaaaattagaattattacaaagaagatttggtggcacagtaattagaaacccattatcaagaaatagtacgcacgaaatgtattacgttagcggggcaagaagtaacgttacattcactgttaatcaaacatcacgattactgatgcgacgaatgagaagaccgacaggaaaggtaacgctagaagctgacgtaatacttccaataggaacaaggagtgtagaaacagataaaggcccactggataaggaagcaatagaagaaagagttgaaagaataaaaagcgaatacatgacaagttggttttatgacaatgataatccatatagaacatggcattattgtggaagctatgtaacaaaaacttcaggttcagctgctagcatggtaaacggagttatcaaaatactaacatacccttgggatcgtattgaagaggtaactcgaatggcaatgacagatacaacaccctttggacaacaaagagtcttcaaagagaaggtagatacaagagcgaaagacccaccagcaggaacacgaaaaataatgaaggtagtaaatagatggttattcagacatctggcaagagagaaaaatccaagactatgtacaaaagaagaatttattgcgaaagttagaagtcacgctgctataggcgcttatctggaagaacaagaacaatggaagacagccaatgaagcagtacaggatccaaaattttgggagctagttgacgaagaaagaaaattacatcagcaaggccgatgcagaacatgcgtatacaatatgatgggaaaacgtgaaaagaaattgagtgaatttggaaaagcaaaaggatcaagagcgatttggtatatgtggttaggagcgcgttatttagaatttgaagcattaggatttctaaacgaagatcattgggcttcgcgagaaaatagtggtggtggcgtagaaggaatagggttgcagtacttaggatatgtcataagagatctagcagcaatggatggaggaggtttttatgctgatgatacagctggctgggacactagaataacagaagctgacttggatgatgaacaagaaatactaaactatatgagtccacatcacaagaaattggcacaagctgtaatggaaatgacgtacaaaaataaagtagtaaaagtattaagaccagcaccaggaggtaaagcatacatggatgtaatcagtcgaagagatcaacgaggaagcggacaagtagtaacatacgccctaaatacgattacaaacttaaaagtacaattaataagaatggcagaagctgaaatggtcatacatcaccaacatgtacaagattgcgacgaaagtgtcttaaccagattagaagcatggcttactgaacatggttgtgatagattaaaacgcatggcagttagtggagatgattgtgtggtaaggcctatagacgatagatttggattagctttaagtcacttaaacgctatgtcaaaagttagaaaagatatatcagaatggcaaccatcaaaaggttggaatgattgggaaaatgtgcctttttgtagtcatcatttccatgaacttcaattaaaagacggaaggagaatagttgtaccatgtagggaacaagatgagctaataggtagaggtcgagtctcaccagggaatggctggatgataaaagaaacagcatgtctgagtaaagcatatgcaaatatgtggagcctaatgtattttcataaaagagatatgagattgttaagccttgctgtttcgagcgcagtgccaacgagctgggtaccacaaggaagaacaacatggtcaatacatggaaaaggagaatggatgacaacagaagatatgctagaagtgtggaatagggtttggattaccaataatccacatatgcaagataagacaatggttaagaaatggagagatgttccatatctaactaaaagacaagataaattatgcggtagcttaataggtatgaccaatcgtgcaacatgggcctcacacatccatttagtaatacatagaataaggacgttaataggacaagaaaaatatactgattatctaactgtaatggatcgatacagtgtagatgcggatttgcaacttggcgaactaatt

SEQ ID NO: 303 - RNA, 2334 nt, synthetic construct
  misc_feature 1..2334: note = derived and/or modified CDS sequence (opt6) from YFV 17D__NC_002031.1__C-prME
  source 1..2334: mol_type = other RNA
atgagcggaaggaaagcacaaggaaaaacattgggagtaaatatggtacgtcggggagtaagatctttaagcaataaaataaaacagaaaacaaaacaaataggaaatagaccaggaccatcaagaggagtccaaggctttatattctttttcttatttaatattcttaccggaaagaaaataacagcacacctaaaaagattatggaaaatgctagatccaagacaaggtctagcagtcttaagaaaagtaaaaagagtagtagcgtccttaatgagaggacttagtagcagaaaaagaagaagccacgacgtattaaccgtacaattcctaatactagggatgctactaatgacaggaggtgtcactttagtgaggaaaaatagatggttattattaaacgttacaagtgaagatctcggaaaaacttttagcgtcggaacgggtaactgcacaacgaatatattagaagctaaatattggtgtccagactcaatggaatataattgtccaaatttaagtccacgagaggaacccgatgacatcgattgttggtgctacggcgtagaaaatgtaagagtagcatatggaaaatgcgattccgcaggcagatctagaagatcacgccgagcaatagatttaccaacacatgaaaaccatggattaaaaacgagacaagaaaaatggatgaccggaagaatgggagaaagacaattacagaaaatagaaagatggttcgtcagaaacccattctttgcggttacagcactaacaatagcatatctagtagggagtaacatgacacaaagagtcgttattgctttattggtacttgcagtaggtcccgcatattcagcacactgcattggaattacagatagagactttatagaaggggttcacgggggtacttgggtaagtgctaccctagaacaagataaatgtgtaacagtaatggcaccagacaaacctagtttagatattagcttagaaacggttgctatagatagaccagcagaagtaagaaaagtttgttacaatgcagttttaacacacgtaaaaataaacgacaaatgtccaagtaccggtgaagctcatttagcggaagaaaacgaaggcgataatgcgtgtaaaagaacatactcagatcgaggttggggtaacggatgtggtctattcggaaaaggatccattgtagcctgtgccaaatttacatgtgcaaaatcaatgagcttgtttgaagttgaccaaacaaaaattcaatatgttataagagctcaactacatgtaggcgcaaaacaagaaaattggaacactgatataaaaactcttaaatttgatgcgctaagcggaagtcaagaagtagaatttataggatatggaaaagcaacattggaatgtcaggtacaaaccgcagttgattttggcaatagttatatcgctgaaatggagactgaaagttggatagtagatagacagtgggctcaagacttgacactaccgtggcaatcaggatcaggaggtgtatggagagaaatgcatcatttagtagaatttgaaccaccacacgccgcaaccataagagtacttgcgttagggaaccaagaaggaagtctaaaaacagcactgacaggagcaatgagagtaacaaaagacacaaatgataacaatttatacaaattacatggaggacacgtatcctgcagagtaaaactaagcgctctaacattaaaaggaacgagttataaaatatgcactgacaaaatgtttttcgtcaaaaatcctacggacacagggcatggaacggtagtcatgcaagtaaaagttagtaaaggagctccatgtagaataccagtaatagtagcagacgacttaacagcggcaataaataaaggaatattggtaacagtaaatcccatagcatcaacaaatgatgatgaagtattaatagaagtaaatccaccatttggagattcatatataattgttggacgaggtgatagcagattaacttaccaatggcataaagaaggatcatcaataggaaaattgtttacgcaaaccatgaaaggagtagaaagattagcagtaatgggagacacagcatgggatttttcaagcgcagggggcttctttacaagtgtaggaaaaggaatacacactgtattcggtagtgcgttccaagggttattcggcgggttgaattggattacaaaagtaataatgggagccgtattaatatgggtaggaataaatacccgaaacatgacgatgtcaatgagtatgattcttgtaggagttataatgatgttcctaagtttaggagtaggtgct

SEQ ID NO: 304 - RNA, 3390 nt, synthetic construct
  misc_feature 1..3390: note = derived and/or modified CDS sequence (opt6) from YFV 17D__NC_002031.1__C-prME-NS1
  source 1..3390: mol_type = other RNA
atgtcgggaagaaaagcccaaggaaaaacactcggagtaaatatggtacgcagaggagtcaggtccctatcgaataaaattaaacagaaaaccaaacagatcggaaatcgaccaggacccagccggggcgtccaaggatttattttcttctttctatttaacatattaacaggcaagaaaatcaccgctcacttaaaaagactttggaaaatgcttgatccacgccagggattagccgtattaagaaaagtaaaaagagtagtagcaagtcttatgagaggattgagttcaagaaaaagacgatcacacgatgttctaactgtacaatttttaatcctgggaatgctattaatgacaggcggtgtaactctagtgcgtaaaaatagatggttattactaaatgtaacaagcgaagacctgggtaaaacgttttcagttggcacgggtaattgtaccactaatattctcgaagcaaaatactggtgcccagatagcatggaatacaattgcccaaatttatctccaagagaagaaccagatgacattgactgttggtgttatggtgtcgaaaacgtaagagtggcttatggaaaatgcgacagtgcgggtagaagtcgacgctcaaggcgagcaatagatctgcccactcacgagaatcatggattaaaaactcgacaagaaaaatggatgacagggagaatgggggaacgccaattgcagaaaatagaaagatggtttgtacgcaaccccttctttgccgtaacggcattaaccatagcatatctagtaggaagtaatatgacccaaagagtagtaattgcactcttagtattagcagtagggccagcttactccgcacactgtataggtataacagatagagacttcatagagggagtacatggaggtacatgggttagtgctacattagaacaagataaatgcgttacagtaatggcaccagacaaaccaagtctggacataagtctagaaacagtcgctatagatagacccgcagaagttagaaaagtttgttacaacgcagtattgacgcatgttaaaataaacgataaatgcccaagtaccggtgaggcacatcttgcagaagaaaatgaaggagataatgcttgcaaaagaacatactcagaccggggatggggaaatggttgtggtctatttggtaaaggatctatagtggcctgcgcgaaatttacatgtgcaaaatcaatgagccttttcgaagttgatcaaacaaaaattcaatatgtgatacgagcacaactacatgtaggagcaaaacaagaaaattggaatacagatataaaaacactaaaatttgacgcgttaagcggatcgcaagaagtggagttcataggctacggtaaagcaaccctagaatgccaagtccaaacagcagtagattttggaaattcatatatagcggaaatggaaacagaaagctggattgtcgatcgacaatgggctcaagacttaactctgccttggcaatcaggatcaggaggagtttggagagaaatgcatcacctagttgaatttgaacctccacatgcagcaacaataagagttctagcactaggaaatcaagaaggctcactcaaaacagcattaacaggagcaatgagagtaactaaagacacaaacgataacaacctatacaaacttcatggaggtcacgttagttgtagagttaaactatcagcgctgacgctaaaaggaacaagttataaaatttgtacagataaaatgttctttgttaaaaatccaacagacacaggtcatggaactgtcgttatgcaagtcaaagtatcaaaaggagctccatgtcggattccggttattgtggcagatgaccttactgccgctataaataaaggaattttggtaactgtaaatccaatagcatccactaatgacgatgaggtgctaatagaggtaaatcccccgtttggcgattcttacataatcgtcggaagaggagatagtagacttacgtaccaatggcataaagagggtagttccataggtaaattatttactcaaacaatgaaaggagtggaacgacttgcagtaatgggtgacacagcgtgggatttttcctcagcaggaggattctttacctcagtaggtaaaggtatacataccgtatttggttcagcctttcaaggactattcggaggtctaaattggataacaaaagtaatcatgggagcagttctcatctgggtgggcattaacacaagaaatatgactatgagtatgagtatgatattagtaggggtgattatgatgtttttatcacttggggtgggcgcagaccaaggatgtgcaataaacttcggaaaaagagaattaaaatgcggtgatggaattttcatattccgcgacagtgatgattggttgaataaatactcatattatcccgaagacccagtgaaacttgctagcatcgtaaaagcatcgtttgaagaaggaaaatgcggattaaattctgttgacagtttagaacatgagatgtggagatcaagagcggacgaaataaacgcaatatttgaagaaaatgaggtagatattagtgtagtagtacaagatcctaaaaatgtatatcaaagaggtacccacccattttcacgtattagagatggcttacaatatggatggaagacttggggaaagaatttagtattttcaccaggaaggaaaaacggtagctttataatagatggcaaatccagaaaggaatgcccattcagcaacagagtatggaacagttttcaaatagaagaatttggaacaggtgtatttacaaccagagtatatatggacgcagtgttcgaatatacaatagactgcgacggatcaatattaggagcagccgtaaatggaaagaaatcagcacacggaagtccaaccttttggatgggaagccacgaggtaaatggtacatggatgatacatacgctagaggctttagattataaagaatgcgaatggccactaacacacactatcggaacatctgtagaagaaagtgaaatgtttatgccaagaagtataggcggtccagttagtagccataatcatatacctggatataaagtacaaacgaatggaccatggatgcaagttccgttggaagtaaaaagagaagcatgccctggcacatcagtaataattgacggaaactgtgatggtcgagggaaaagtacaagaagtacaacagattcaggcaaagttataccagaatggtgttgtcgttcatgtacaatgccaccagtatcatttcatgggagtgacggatgttggtacccaatggaaataagaccaagaaaaacacatgaaagccatttagttcgatcatgggtgacagcc

SEQ ID NO: 305 - RNA, 30 nt, synthetic construct
  misc_feature 1..30: note = derived and/or modified CDS sequence (opt6) from YFV 17D__NC_002031.1__X or 10aa (5'-terminus)
  source 1..30: mol_type = other RNA
atgagagggctaagtagcagaaaaaggaga

SEQ ID NO: 306 - RNA, 60 nt, synthetic construct
  misc_feature 1..60: note = derived and/or modified CDS sequence (opt6) from YFV 17D__NC_002031.1__SS or ER anchor (v1)
  source 1..60: mol_type = other RNA
agtcatgacgtattaacagtacaatttttaatattaggaatgttattaatgacaggagga

SEQ ID NO: 307 - RNA, 54 nt, synthetic construct
  misc_feature 1..54: note = derived and/or modified CDS sequence (opt6) from YFV 17D__NC_002031.1__SS or ER anchor (v2)
  source 1..54: mol_type = other RNA
gatgtattaacagtacaatttctaatactaggaatgttactaatgacaggagga

SEQ ID NO: 308 - RNA, 72 nt, synthetic construct
  misc_feature 1..72: note = derived and/or modified CDS sequence (opt6) from YFV 17D__NC_002031.1__SS or ER anchor (v4)
  source 1..72: mol_type = other RNA
tcacatgacgttttaactgtacaatttttaatacttggaatgttattaatgactggaggtgtaactttagtt

SEQ ID NO: 309 - RNA, 90 nt, synthetic construct
  misc_feature 1..90: note = derived and/or modified CDS sequence (opt6) from YFV 17D__NC_002031.1__X-SS or 10aa (5'-terminus)-SS (v1)
  source 1..90: mol_type = other RNA
atgagaggactatcaagcagaaaaagaagatcacacgatgtattaacagtacaatttctaatactaggaatgttactaatgacaggagga

SEQ ID NO: 310 - RNA, 102 nt, synthetic construct
  misc_feature 1..102: note = derived and/or modified CDS sequence (opt6) from YFV 17D__NC_002031.1__X-SS or 10aa (5'-terminus)-SS (v2)
  source 1..102: mol_type = other RNA
atgagaggactaagtagtagaaaaagaagaagtcatgatgtattaacagtacaatttctaatattaggaatgttactaatgacaggaggagtaacattagta

SEQ ID NO: 311 - RNA, 30 nt, synthetic construct
  misc_feature 1..30: note = derived and/or modified CDS sequence (opt6) from YFV 17D__NC_002031.1__XX or 10aa (3'-terminus)
  source 1..30: mol_type = other RNA
gatcaagggtgcgcgataaatttcggaaaa

SEQ ID NO: 312 - RNA, 2091 nt, synthetic construct
  misc_feature 1..2091: note = derived and/or modified CDS sequence (opt6) from YFV 17D__NC_002031.1__X-SS-prME-XX
  source 1..2091: mol_type = other RNA
atgagaggattatcaagtagaaaaagaagatcacatgatgtactaaccgtgcaatttttgatcttagggatgctcttaatgacaggaggtgttacattagtaagaaagaatcgatggctgcttttaaatgtgacatcagaggatttagggaaaacattttcggtaggaacaggaaattgtactacaaatatacttgaagcaaaatattggtgcccagactctatggaatataattgtccaaatttaagtcctagagaagaacctgacgatatagattgttggtgttatggtgtagaaaatgtaagagtagcatacggcaaatgcgatagtgcaggacgttctagacgttcaaggagagccatagatctgcccactcacgaaaatcacggattgaaaacacgacaagaaaaatggatgactgggcgaatgggagaaagacaactacagaaaattgaaagatggttcgttagaaatccattctttgccgtaacagctttaacaatagcctatttagtaggtagtaatatgacacaaagagtagtaatagcattgctagtgttagcagttggaccagcttatagtgcacattgcataggaataacagatagagactttatagaaggagtacacgggggaacttgggtaagtgccactttagaacaagataaatgtgttacagtgatggcgccagataaaccaagtctggacataagtttggaaacagtagcgattgatagacccgcagaagtaagaaaagtttgttataatgctgttctaacccatgttaaaataaatgataaatgccctagcaccggagaagcccatctagcagaagaaaatgaaggagataacgcatgtaaacgaacatactcagatagaggatggggcaacggatgtggcttgtttggaaaaggtagcatagtagcatgcgctaaatttacatgcgcaaagtcaatgtcattatttgaagtagatcaaacaaaaatacaatatgtaataagagctcaattacacgtgggtgcaaaacaagaaaattggaatacagacataaagacactaaagttcgacgcattaagtggatcacaagaggtagaatttatagggtacggaaaagcgactttagagtgtcaagtccaaacagcagtagatttcggtaactcatacatagcagaaatggaaactgaaagttggatagtagatagacaatgggcacaagacttgacactaccttggcaatcaggaagcggaggagtatggagagaaatgcatcatttagtagaatttgaaccacctcatgcagcaacaataagagtattagccctaggaaaccaagaaggaagtttaaaaacagcactaacaggagctatgagagtaacaaaagatacaaatgacaacaatctatacaaattacacggaggacatgtaagctgccgggtaaagttgagcgcactaacattaaaaggaacgagttataaaatatgcacagataaaatgttctttgttaaaaatcctacagataccggtcatggaacagtagtaatgcaagtaaaagtaagtaaaggcgctccctgtagaatacctgtaatagtcgcagacgatttaaccgcagcaataaataaaggaatattagtcacggtaaacccaatagcgtcaacaaatgatgatgaagtattaatagaagttaacccaccttttggagacagttatataatagtcggaaggggtgatagtagactaacataccaatggcataaagaaggaagctcaataggaaaattatttactcaaaccatgaaaggtgtagaaaggctagctgttatgggtgacacagcatgggatttttcaagcgcaggagggttctttacatcagtaggtaaaggaatacatacagtatttggaagtgcatttcaaggattatttggtggtttaaattggataacaaaagtaataatgggcgcagttttaatatgggtaggtataaacacaagaaatatgacaatgtctatgagtatgatattggtcggagtaataatgatgtttttatcactaggagtgggtgcagatcaaggttgcgctattaattttggaaaa

SEQ ID NO: 313 - RNA, 1581 nt, synthetic construct
  misc_feature 1..1581: note = derived and/or modified CDS sequence (opt6) from YFV 17D__NC_002031.1__X-SS-E
  source 1..1581: mol_type = other RNA
atgagaggattaagtagccgaaaacgaagatcacatgatgtattaacagtacaatttctaattctaggaatgctgttaatgacaggaggagtgacattagttgcacattgtataggaataacagaccgagattttatagaaggtgtacatggaggcacatgggtatcagcaacattagaacaagacaaatgtgtaactgtaatggcacctgataaaccaagtctagatataagtctagaaacagtagctatagatcgaccagcagaagttagaaaagtatgttacaatgctgtactaacacacgttaaaataaatgataaatgtccaagtaccggagaagcacatttagcagaagaaaatgaaggagataacgcatgtaaaagaacttacagtgatagaggatggggaaatggatgcggtctattcggaaaaggaagtattgtagcatgtgcaaaatttacatgtgcaaaaagtatgtcattatttgaagttgaccaaactaaaatacaatacgtaattagagcacaactacacgtgggagctaaacaagaaaactggaataccgatattaaaacattaaaatttgatgcattaagcggatcacaagaagtagaatttatcggctacggaaaagcaacattggaatgccaagtacaaactgcagtagatttcgggaatagttatatagcagaaatggaaactgaaagttggattgtagataggcaatgggcacaagatttaacactgccatggcaaagcggatcaggaggggtatggagagaaatgcaccacttagttgaatttgaaccaccacatgctgcaacgattagagttctggctttaggaaatcaagaaggatcactaaaaacagccttaacaggtgcaatgagagtaaccaaagatacaaatgacaataatttatacaaattacatggaggacatgttagctgtagagtaaaactatcagcattaactttaaaagggacaagttacaaaatttgtactgataaaatgtttttcgtgaaaaatcccacagatactggtcatggcacagtagtaatgcaagtaaaagtaagtaaaggagcgccttgtaggattccagtaatagtagcagacgatttaacagcagcaataaataaaggcatcttagtaacagtaaatcccatagcatctacaaatgacgacgaagtattgatagaagtaaatccaccattcggagattcatatataattgtaggaagaggtgacagtagattgacatatcaatggcacaaagaaggaagcagtataggaaaattatttacacaaacaatgaaaggagtagaaagattagctgtcatgggagatacagcttgggatttctcaagtgcaggaggtttctttacatcagtaggaaaaggaatacatacagttttcggttcagcattccaaggattattcggaggattaaattggataacaaaagtaataatgggagcagtattaatatgggtcggaataaacacaagaaatatgacaatgtcaatgtcgatgatattagtaggtgtaataatgatgtttctaagtttgggagtaggtgcc

SEQ ID NO: 314 - RNA, 1611 nt, synthetic construct
  misc_feature 1..1611: note = derived and/or modified CDS sequence (opt6) from YFV 17D__NC_002031.1__X-SS-E-XX
  source 1..1611: mol_type = other RNA
atgagagggctatcaagtagaaaaagaagatcacatgatgtattaacagtacaattcctaatactaggcatgttattaatgacaggaggagtgacgctagttgcccactgtataggaattacagaccgtgattttatagagggagtacatggaggaacatgggtaagtgcaacattagagcaagataaatgtgttacagtaatggcacctgataaacccagcttagatataagtctcgaaacagtagcaatagatagaccagcagaagtaagaaaagtttgttataacgcagtattaactcacgtaaaaataaacgataaatgtccaagcactggagaagcacatctagcagaagaaaatgaaggtgataacgcatgtaaaaggacgtatagtgatagaggatggggaaatggatgcggactattcgggaaaggaagtattgtagcatgcgctaaatttacatgtgcaaaatccatgagtttatttgaagtagatcaaacaaaaatacaatatgtaataagagcccagctacatgtcggagcaaaacaagaaaattggaatactgatataaaaacattaaaatttgatgcgctatcaggatcacaagaagtagaatttataggatatggaaaagcaactctagaatgtcaagtacaaacagcagtagactttggaaatagttacatagcagaaatggaaacagaaagttggatcgtagatagacaatgggctcaagacttaacactaccatggcaaagtggcagtggaggagtctggagagaaatgcatcacttagtagaatttgaacctcctcacgcagcaacaataagagtattagctttaggaaatcaggaaggcagtttgaaaacagcattaacgggtgctatgagagtgactaaagacactaatgataataatctttataaactacatggagggcacgtaagctgtagagttaaattaagtgcgttaacattaaaaggtacaagctacaaaatatgcacagacaaaatgttctttgtgaaaaatccaacagacacaggacatggcacagtagtaatgcaagtaaaagtatcaaaaggagcaccatgtaggataccagtaatagtcgcagatgatttaacagcagcaataaataaaggtatattagtaacagttaatcctattgcatcaactaatgatgatgaagtactaatagaagtaaacccaccgtttggagacagttacataatagtcggaagaggagacagcaggctaacatatcaatggcataaagaaggtagctcaattggaaagctattcacgcaaacaatgaaaggagtcgaaagattagcagttatgggagacacagcatgggattttagtagtgcgggagggttctttacatcagttggtaaaggtattcatacagtatttggaagtgcatttcaaggactatttggaggattaaattggataacaaaagtcatcatgggagcagtattaatatgggtaggaataaatacaagaaatatgacaatgagcatgagtatgatattagtaggagtaataatgatgtttctaagcctaggagtaggtgcagaccaaggatgtgcaatcaacttcggaaag

SEQ ID NO: 315 - RNA, 2025 nt, synthetic construct
  misc_feature 1..2025: note = derived and/or modified CDS sequence (opt6) from YFV 17D__NC_002031.1__SS-prME
  source 1..2025: mol_type = other RNA
gatgttctaacagtacaatttttaatattagggatgttattaatgacaggaggcgtaacattagtacgaaagaatcgatggctattactaaacgttacgtctgaagatttaggaaaaacatttagcgtaggaacaggaaattgcaccacgaatatcttagaagcaaaatattggtgtccagatagtatggaatacaattgtccaaatttaagtcctagagaggaacccgacgatatagattgctggtgttacggagtggaaaatgtaagagtagcatatggaaaatgtgacagcgcaggtagaagtagaagatcacgacgagcaattgatctacccactcatgagaaccatggactaaaaacaagacaagaaaaatggatgacaggtagaatgggcgaaagacaattacagaaaatagaaagatggtttgtacgaaatcctttctttgctgtcactgcattaactatagcttatttagtaggaagtaacatgactcaaagagtagtaatagcactattagtactagcagtaggaccagcttacagtgcacactgtatagggataacggatagagattttatagaaggagtacatgggggtacatgggtgtctgccactttagaacaagacaaatgtgttacagttatggccccagataaaccctctttagacatatcattagaaactgtagcaatagatagaccggcggaagtgagaaaggtatgttataatgcagtactaacccatgtaaaaattaatgacaaatgcccatcaacaggagaggctcatctagctgaagaaaatgaaggagacaatgcttgcaaacgtacatattcagacagggggtggggaaatggatgtggattatttggtaaagggtcaatagtagcatgtgcaaaatttacatgcgcaaaaagtatgagcttatttgaagtagatcaaacaaaaatccaatatgtaattagagctcaacttcacgtaggagcaaaacaagagaattggaacacagatataaaaacattaaaatttgacgctttgtctggaagtcaagaagtcgaatttattggctatggaaaggcaacattagaatgccaagttcaaaccgcagtagattttggaaattcatacatagcagaaatggagactgaaagttggatagtagatagacagtgggctcaagacctaactttaccatggcaatcaggaagtggtggtgtatggagagaaatgcatcatttagtagaatttgaaccaccacatgcagcaacaattagagtactagcattaggaaatcaagaaggtagtttaaagacagcgcttaccggagcaatgagagttacaaaagatactaatgacaataatttatataaacttcatggaggacatgttagctgtagagtcaaattaagtgcattaacactcaaaggaacatcatacaaaatatgtacagataaaatgtttttcgtcaagaatccaacagatacaggacatggaacagttgtaatgcaagtaaaagtatcaaaaggagcaccttgcagaataccagtaatagtagcagatgatttaacagccgcaattaataaagggatattagtaacagtaaaccctatagcaagtacaaatgatgatgaagtcttgatagaagtaaatccaccatttggagattcgtatataatagtcggaagaggagatagtcgattaacatatcaatggcataaagaaggttcatcaataggaaaattatttacacaaaccatgaaaggagttgaaagattagctgtaatgggggacacagcttgggatttttctagcgcaggaggattctttacatccgtaggaaaaggtatacacacagtatttggctcagcattccaagggttatttggtggtttaaattggataacaaaagtgattatgggagcagtgctaatctgggtaggaataaatacaagaaatatgacaatgagtatgagcatgattctcgtaggagtaataatgatgttccttagtttgggagttggcgct

SEQ ID NO: 316 - RNA, 3081 nt, synthetic construct
  misc_feature 1..3081: note = derived and/or modified CDS sequence (opt6) from YFV 17D__NC_002031.1__SS-prME-NS1
  source 1..3081: mol_type = other RNA
gatgtattaaccgtacaattcttaatattaggaatgctgctaatgacaggtggagtaaccttggtaagaaagaatagatggttattactaaacgtaacttcagaagacttaggaaaaacatttagtgtaggaactggaaattgcaccacaaacattttagaagcaaaatattggtgtcccgatagtatggaatataactgtccaaacttatcaccacgagaagaacctgatgacatagattgctggtgttatggagtagaaaatgtaagagtggcatatggaaaatgtgatagtgcaggcagatctaggagatcgagacgagcaattgacctacctacacatgaaaaccatggtctaaaaacaagacaagaaaaatggatgacaggaagaatgggtgaaagacaactacagaaaattgaaagatggttcgtaagaaatccattcttcgcagtaacggcattaacaatagcatatttagtagggagtaatatgacacaaagagtagtgatagcgttgctagtattagcagtaggtcctgcatattctgctcactgtataggaattacggatagagacttcatcgaaggagtacatggaggaacatgggttagcgctacgctagaacaagataaatgtgtaactgtgatggcacctgataaaccatcgttagatatcagcttagaaactgtagcaatagacagaccagcagaagtacgaaaagtatgttacaatgctgtattaacacatgtaaaaataaatgacaaatgtccgtccactggagaagcacatttagcagaagaaaatgagggcgataatgcatgtaaacgcacttattcagaccgaggatggggaaatggttgcggattatttggaaaaggctcaatagtagcatgtgcaaaatttacgtgtgcaaaatcaatgtcactatttgaagtcgatcagaccaaaatacaatacgtaataagggcacaattacacgtcggagcaaaacaggaaaattggaatactgatataaaaacattaaaattcgatgcactctcaggatcacaagaagtagaatttataggatatgggaaagcaacgttagaatgccaggttcaaactgccgtcgattttggtaattcatatatagcagagatggaaacagaaagctggatcgtggatcgtcaatgggcacaagatttaacattaccctggcaatcaggatcaggaggtgtttggcgagaaatgcaccatttggtagaatttgaacctccacacgcggcaacaataagagtcctagcacttggtaatcaggaagggagcttaaaaaccgctttaacaggagcaatgagagtgacaaaagacacaaatgataacaatttatataaactccatggaggacatgtatcatgccgcgtaaaactatcggcattaacattgaaaggcacgtcatataaaatctgtacagataaaatgtttttcgtaaagaatccgaccgacacaggtcatgggactgttgtaatgcaagtaaaagtctcaaaaggagctccttgcagaatacctgtaattgtagccgatgatctaacagcagccattaataaaggcatactcgtaacggttaaccctatagctagtactaatgatgatgaagtattaatagaagtaaatcccccttttggagactcatatataatcgttggaagaggagactcaagattaacgtaccaatggcataaggaaggatcaagtataggtaaattattcacacaaacaatgaaaggagtcgaacgactcgcggttatgggagacacagcttgggatttttcatcagccgggggattctttacaagcgtaggtaaaggaatccatacagtgttcggttctgcattccaaggtttgttcggaggattgaattggataaccaaagtaataatgggcgcagtactaatatgggttggcataaacacccgaaacatgacaatgagcatgagtatgatacttgttggtgttataatgatgttcctctcactaggggttggggctgatcaaggatgtgccatcaattttggaaaacgcgaattaaaatgcggagatggtatatttatatttagagatagtgacgattggttaaataaatatagttattatccagaggatcccgtgaaactcgcctctattgtaaaggcttcattcgaagaggggaaatgcggcttaaattccgtagacagcttggaacatgaaatgtggagatctagagcagatgaaataaacgcaattttcgaagaaaatgaggttgatataagcgtagtcgtacaggaccccaaaaacgtttatcaaagaggtacacatccgttctcaagaatcagagatggactacagtatggatggaaaacatgggggaaaaatctggtttttagtccgggacgaaagaacggatccttcataatagatggaaaaagtagaaaagaatgtccatttagcaacagagtctggaatagttttcaaattgaagaatttggaactggcgtatttactacaagagtatatatggatgcagtatttgaatacacaattgactgtgatggatccattctaggagctgcagtaaatggaaagaaaagcgcacatggatcaccaacattttggatgggatcacacgaagtaaatggaacatggatgatacatacactagaagcacttgattataaagagtgtgaatggccgctaacacatactataggtacaagtgtagaggaatcagaaatgttcatgccaaggtcgattggaggtccagtaagctcacacaatcatatacctggatataaagtacaaacaaacggaccttggatgcaagtgcctttagaagtgaaaagagaagcatgtcctggcacatcagtgataatcgacggaaattgtgatgggaggggaaaaagcacacgtagcacaacagactctgggaaagtcattcctgaatggtgttgccgatcatgtactatgccgccagtcagcttccatggaagcgatggatgctggtatccaatggaaattagaccaagaaaaacacatgaatctcatctagtcagatcgtgggtaacagca

SEQ ID NO: 317 - RNA, 273 nt, synthetic construct
  misc_feature 1..273: note = derived and/or modified CDS sequence (opt6) from YFV 17D__NC_002031.1__C (without X-SS)
  source 1..273: mol_type = other RNA
atgagcggaagaaaagcacaaggaaaaacactaggagtaaacatggtaagaagaggagtaagaagcctaagcaacaaaataaaacaaaaaacaaaacaaataggaaacagaccaggaccatcaagaggagtacaaggattcatattcttcttcctattcaacatactaacaggaaaaaaaataacagcacacctaaaaagactatggaaaatgctagacccaagacaaggactagcagtactaagaaaagtaaaaagagtagtagcaagccta

SEQ ID NO: 318 - RNA, 1026 nt, synthetic construct
  misc_feature 1..1026: note = derived and/or modified CDS sequence (opt6) from YFV 17D__NC_002031.1__NS1 (without XX)
  source 1..1026: mol_type = other RNA
agagagctaaaatgtggagatggtatttttatatttagagattcagatgattggttaaataaatatagttattacccagaagatccagtaaaattagcaagtatagtgaaagctagttttgaagaaggaaaatgtggattaaatagtgttgatagtctagaacatgaaatgtggaggagtagagcggatgaaataaatgcaatattcgaggaaaatgaagtagatataagcgtagtagtacaagacccaaaaaatgtatatcaaagaggaacacacccatttagcagaataagagatggattacagtacggatggaaaacatggggaaaaaatttagtattcagcccaggaagaaaaaatgggtcatttattatagacggaaaaagtagaaaagaatgtccattttcaaatagagtatggaatagttttcaaatagaagaatttggaacaggagtatttacaacaagggtatatatggatgcagtatttgaatatacaatagactgtgatggaagtatattaggagcagcagtaaatggaaaaaaaagcgcacacggatcgccaacattttggatgggaagtcatgaagtgaatggtacatggatgattcatacattggaagcactagattataaagaatgtgaatggccattaacacatacaataggtacgagcgtagaagaaagcgaaatgtttatgccaagaagtattggcggaccagtaagtagtcataatcatataccaggatataaagtacaaacaaatggaccctggatgcaagttccattagaagtaaaacgagaagcatgtccaggaacaagtgtaataatagacggaaactgtgacggaagaggaaaaagcacaagatcaacaacagatagtggaaaagtaataccagaatggtgttgtagaagctgcacaatgccaccagtaagttttcatggatcagatggatgttggtatccaatggaaattaggcctagaaaaacacatgaaagtcatttagtaagaagctgggtgactgca

SEQ ID NO: 319 - RNA, 10233 nt, synthetic construct
  misc_feature 1..10233: note = derived and/or modified CDS sequence (opt11) from YFV 17D__NC_002031.1__polyprotein
  source 1..10233: mol_type = other RNA
atgagcggtaggaaggcccagggaaaaaccctgggcgtgaacatggtccggagaggggtgagatccctgagcaacaagatcaagcaaaagacgaaacagatcggcaaccgcccggggcccagccgtggtgtgcagggcttcatcttcttcttcctgttcaacatcttgacggggaagaagatcacagcacacctcaagcgcctatggaagatgctggacccccggcagggccttgcggtgctgcgcaaggtgaagcgggttgtagcctcactgatgcgcgggttgtccagccggaaacgcaggtcccacgacgttctgacagtacagttcctcatcctcggcatgctactgatgaccgggggcgtaacgttagtgcgcaagaataggtggctgttattaaacgtgaccagcgaggacctaggcaagactttttccgtcgggaccggcaactgcacgaccaacatcctggaggccaaatactggtgtccggactcaatggagtacaactgccctaatctctctccacgcgaggagcccgacgacatcgattgttggtgctatggtgttgagaacgttcgagtagcttacggcaagtgcgactcagccggccgctcacgacgcagccggcgggcgatcgacttgcctacccatgagaatcacgggctgaagacgcgccaggagaaatggatgacgggtcggatgggcgagcgccagctccagaagatcgagcggtggttcgtgcgcaaccccttcttcgctgttaccgccctgaccatcgcttaccttgtcggtagtaacatgacccagcgggtggtgatcgcgctactggtccttgccgtgggtcccgcgtacagcgcccactgtatcggaatcacggaccgcgattttatcgagggggtgcatggaggcacctgggtctccgcaaccctcgagcaggacaagtgcgtgactgtcatggcgcccgataagcccagcctagatatctccctagagaccgtggcaatagaccggccggctgaggtacggaaagtctgctataacgctgtcttgacccatgtgaaaatcaacgacaagtgccctagcacgggcgaagcccacctggccgaggagaacgagggagacaacgcctgcaagcggacctacagcgaccgaggatggggcaacggatgtgggctgttcggtaagggctcgatcgtcgcctgcgcgaagttcacgtgcgctaaaagcatgtcactcttcgaagtggaccagaccaaaatacaatatgtgatacgggcccagctgcacgtcggcgccaagcaagaaaattggaacactgacatcaagaccctgaaatttgacgcgctcagcggaagtcaggaagtggaatttatcggctacggtaaggccacgctagagtgccaggtacaaacagccgttgactttgggaacagttatatcgcggagatggagacagagtcctggatcgtggatcgacaatgggcccaggacctaacgctcccttggcagtcgggcagtggaggcgtgtggcgagagatgcaccacctggtcgagtttgagccgccccacgccgcgacgatccgcgtactggcgctcggaaatcaagaggggagcctgaaaaccgcgctgacgggcgccatgagagtgaccaaggacacgaacgacaataacctctacaagttgcacggtggccacgtcagctgccgcgtgaagctgtctgccctgaccctcaagggcacctcctacaaaatctgcaccgacaaaatgttcttcgtaaaaaacccgaccgacacaggccatggcaccgtcgtgatgcaggttaaggtcagtaagggggccccctgccggatccccgttatcgtggcggacgacctgaccgccgccatcaacaagggcatcctggtcacagtgaacccaatcgcctcgaccaacgatgatgaggtgctgatcgaggtcaatccgccattcggggatagctatatcatcgtggggagaggggattcgaggcttacttaccagtggcacaaggaggggagctccattggtaagttgtttacacagacaatgaagggggtggaacgactcgcagtcatgggcgataccgcgtgggacttttcgagtgctggaggctttttcacctctgtcgggaagggcatccacacagtgtttggcagcgccttccaggggttattcggggggctgaactggatcacgaaggttattatgggagccgtgctcatctgggtggggatcaacacgcggaacatgacgatgtccatgtccatgatcttagtaggcgtcataatgatgtttctatcactcggcgtgggggcagaccaaggctgcgccattaattttggcaagcgtgagctgaaatgcggcgacggcatcttcatatttcgcgatagcgacgattggctaaacaagtactcctactatcccgaggaccccgtcaagctcgcgagcatcgtgaaagcctcttttgaggaagggaaatgcggcctgaacagcgtagactcccttgaacacgagatgtggcggagccgcgccgatgagattaacgccatcttcgaggagaacgaagtggatatatccgtcgtagtccaggacccgaagaacgtgtaccagagggggactcacccattcagtaggatacgggacggcctccagtacgggtggaagacttgggggaagaacctggtattttcgcccggacgaaagaacgggagcttcataatcgacgggaaatcccggaaggagtgccccttcagcaatagggtctggaacagctttcagattgaggagttcggcacgggcgttttcaccacccgggtctatatggacgccgtgttcgaatacacgatcgattgcgatgggtcgatcctgggggccgccgtgaatggcaagaagagtgcccacggtagcccgacgttctggatgggcagccacgaggtcaatgggacttggatgatccacaccttagaggcactggactacaaggagtgcgaatggcccctaacccacacgatagggacatccgtggaggagagcgagatgttcatgccccgctccatagggggccctgttagctcccacaaccacatcccaggctacaaagtccagaccaacgggccatggatgcaggtccccctcgaggtgaagcgggaggcatgtccgggcaccagtgtgatcatagatgggaattgtgacggccgcggtaagtccacgcggagcactaccgactctgggaaggtaataccggagtggtgctgccgcagttgtacgatgccacctgtctccttccacggcagcgacggttgttggtacccgatggagatccggccccgcaagacgcacgagtcgcacctcgtccggagctgggtgacagccggcgagattcatgctgtgcccttcgggttagtctccatgatgattgcgatggaggtagtcctccgcaagcggcagggccccaagcagatgctggtagggggggtggtgctattgggcgcgatgctggtcggccaagtgaccctgctcgacctgctgaagctcacagtggccgtcggtctgcacttccacgagatgaataacgggggcgacgccatgtacatggccctgatcgccgcattcagcatccggccgggtctcctgatcggatttggcctccgcacgttgtggagccctcgtgaacgcctggtactgaccctaggtgccgcaatggtggagatcgcgctgggcggggtcatgggcgggctgtggaagtacctcaatgctgtctccctgtgcattttgacgatcaacgctgtggcctcacggaaagcctccaacaccatcctccccctgatggccctgctcacccccgtcacgatggcggaagtgagacttgcggcaatgttcttttgcgccgtcgtaatcataggggttctgcaccagaacttcaaggacaccagcatgcagaagaccataccgcttgtagccctgaccctgacttcctatctcggcctcacccaaccctttctgggtctctgcgcattcctggccacccggatcttcggaaggcgctcaatccccgtaaatgaggccctcgccgccgcgggcctagtgggagtgctggcaggcttagcatttcaggagatggaaaacttcctcgggcccattgccgtgggcgggctattgatgatgctcgtgtccgtggcgggccgcgtcgacggactggagctgaagaagctcggagaggtgagctgggaggaggaggcggagatctcaggttcgtccgcccggtatgacgttgctctcagcgagcaaggggagttcaaacttctatccgaggaaaaggtcccgtgggaccaggtggtgatgaccagcctggctctggtcggcgcggccttacacccgttcgcgcttctgctcgtcctggccgggtggttattccacgtgaggggcgcccggagaagtggcgacgtcctttgggacatcccgacgccaaaaatcatcgaggagtgtgaacacctggaagacgggatctacggcatattccagagcaccttcttgggggcgtcacagcgtggcgtcggggtcgcccagggcggcgtgtttcacaccatgtggcacgtcacacgaggagcctttctcgtccggaacggaaagaagctgatcccgagctgggcctccgtgaaggaggatctggtagcctacggcggctcatggaaacttgaagggcgctgggacggtgaagaagaagtacaactgatcgcggccgtgcccggcaagaacgtggttaacgtccagacgaaacccagtctgttcaaagttcggaacggcggtgagataggagccgtcgcactggactatccgagcggcacaagcggatcccccatcgttaaccgaaacggcgaggtgatcggcctgtacgggaacggaatcctggtcggggacaacagctttgtgtccgctatcagccaaaccgaggtgaaagaggagggcaaggaggagctccaggagatccctacaatgctgaagaaaggcatgacgaccgtcctggatttccaccccggcgccggcaagacccggcgtttcctaccccagattctcgctgaatgcgcaagacggcgcctgcgaacactggttctggcccccacgcgcgtcgtccttagtgagatgaaggaggcgttccacggtctggatgtgaaattccacacccaagccttcagcgcccacggctctgggcgggaagtgatagacgcaatgtgtcacgccaccctcacgtaccgaatgctggagcccactcgtgttgtgaactgggaggtgattatcatggatgaagctcacttcctggaccccgcgtccattgccgcacgcggctgggcggcgcatcgggccagggcgaacgagtcggcgaccattctcatgaccgcgacgccgcccggcacgagcgacgagttcccccattccaatggggagattgaagacgtccagactgacattcccagtgagccgtggaacaccggccacgactggatcctggcggacaaacggcccacggcgtggttcctgccctcaatacgagccgccaacgtcatggcggcgagtctccggaaggccgggaaaagcgtggtcgtgctgaaccgcaagacgttcgagcgggagtacccaaccatcaagcaaaagaaacctgatttcatcctggcaaccgatatcgccgaaatgggcgcgaacctgtgcgtggaacgcgttcttgactgtcgtaccgcgttcaagccagttctggtcgacgaggggcgcaaggtcgccattaaaggccccctccggatttccgcctcttctgcggcgcagagacgagggcgcatcgggcgcaaccccaacagagacggggacagctactactatagcgagcctacgtccgagaacaatgcccatcacgtatgctggctagaggccagcatgctgttggataacatggaggtccgcgggggcatggtcgcacccctatacggggtggaaggcaccaaaacccccgtgtctcccggcgagatgcggctgagagacgatcaaaggaaggtcttcagagagctcgtgagaaactgtgacctgccggtctggctgtcatggcaggtcgccaaggcggggctcaagacaaacgatcgcaagtggtgcttcgagggccccgaggagcacgagatcctgaacgattctggagagactgtgaaatgcagagcccccgggggcgccaaaaagccacttcgcccgcggtggtgcgacgagcgagtctccagcgaccagtcagccctcagcgagttcatcaagtttgctgagggccggcgcggcgcggcggaggtactggtggtgctgtccgaactccccgatttcctcgccaaaaagggcggggaagcaatggacactattagcgtcttcttacactcggaggagggtagccgggcgtaccgtaacgcgctatctatgatgcccgaggcaatgaccatagtgatgttattcatcctcgctggcctgctgaccagcgggatggtaatattcttcatgtccccgaaggggatcagccgtatgtccatggcaatgggcaccatggcgggctgcggctatctgatgtttctcggaggcgtgaaacccacgcatatctcttacgttatgctgatcttctttgtcctgatggttgtggtcatccctgagcccgggcaacaacgaagcatccaggataaccaagtggcctacctcattatcgggatcctgaccctggtctccgccgttgccgccaacgagctcggtatgctggagaaaaccaaggaggaccttttcggaaagaagaacctcatcccgagctcggcgtcaccctggtcctggcctgacctggatctgaagcccggggccgcatggaccgtgtatgtagggatcgtcacgatgttgagtccaatgctgcaccactggatcaaggtggagtatggcaacctctccctctctggcattgcccagtccgccagtgtgctctccttcatggataaagggatccccttcatgaagatgaacatctcagtcatcatgctgctcgtgtctggctggaacagcatcaccgtgatgcccttgctctgcgggatcggatgtgcaatgctccattggtccctgattttgcccgggattaaggcccagcagagcaagctcgcccagcggcgggtatttcatggtgtcgccgaaaaccccgtagtcgacggtaacccaaccgtggacattgaggaggcgcccgaaatgcccgctctttacgagaagaaacttgcactctacctgttgctcgccctgtccctggccagcgtggcgatgtgtagaaccccgttctccctggcggagggcattgtcctggcctctgccgccctgggcccgctaatcgaggggaacacatcccttctctggaacggccctatggcggtcagcatgacgggcgttatgcgtgggaaccactacgccttcgtcggggtgatgtacaatctctggaaaatgaagaccggccgccgtggaagcgcaaacgggaagacgctgggagaggtatggaagcgcgagctcaacctcctggataagcggcaatttgagctgtacaagagaacggacatcgtcgaggtggacagagacactgcccggcggcacctggctgagggcaaggtggacaccggagtcgcggtgtcccgtggcacggccaagttacggtggttccacgaacgcgggtacgtgaagctggagggtcgggtcatcgacctcgggtgcggcagaggcgggtggtgttactacgccgccgcgcagaaggaggtaagcggtgtgaaagggttcacgctgggccgggacggacacgagaagcccatgaacgtacagtcactgggatggaacatcatcaccttcaaggacaagacagacatccaccgcctcgagccggttaaatgtgacaccctgctttgcgacattggtgagtcgtccagctcgagcgtgacggagggggagcggaccgtacgcgtgctcgacaccgtggaaaagtggctcgcatgcggcgtcgacaacttttgcgtgaaggtactggccccatatatgcccgacgtcctcgaaaagctcgagctgctgcagcgacgtttcggtggcaccgttatccggaacccactctcgcgcaacagtacgcacgagatgtactacgtgtcgggagcccgcagcaacgtcaccttcaccgtgaaccaaacctcccggttgctgatgcgtagaatgcgccggcccacgggcaaggtcaccctggaggccgacgtcattctgcctatcggcacccggtcggtagagaccgacaaggggccgttagataaggaggcgatcgaagagagggtggagcgcatcaaatccgagtacatgacgagctggttctacgacaacgacaacccttatagaacctggcattattgcggcagctacgtgaccaaaacctccgggagcgccgcttccatggtcaacggcgtcattaaaatcctcacctacccgtgggaccgcatagaggaggtgactcggatggctatgacagacactaccccattcggccaacagcgggtgtttaaagaaaaggtcgacacgcgggccaaggatccgcccgcgggaacacgcaagatcatgaaggtggtgaaccgatggcttttccgccacctggcccgcgagaagaacccccgcctctgcaccaaggaggagttcattgccaaagtccggagccacgccgcaatcggcgcgtacctggaggagcaggagcaatggaagaccgccaacgaggccgtgcaggaccccaagttctgggagctggttgacgaagaacgcaagttacaccagcaggggcgctgccggacgtgcgtttacaatatgatgggcaaacgagaaaagaagttgtccgagtttgggaaagctaaaggcagccgagccatctggtacatgtggcttggcgcgcgctacctcgagttcgaggcccttgggttcctgaacgaggaccactgggcctcgcgggagaactctggcggaggcgtggaagggatcggcctacaatacctcggctacgtgatcagagacttggccgcgatggacgggggcgggttctacgccgacgacactgctggctgggacacccgcatcacagaggccgacctcgacgacgagcaggagatcctgaactacatgagcccccaccacaagaagctggcccaggcggtcatggaaatgacgtataagaacaaggtagtgaaggtcctccgccccgcccccgggggcaaagcctacatggacgtgatctcgaggcgcgaccaaaggggctccggtcaggtggtcacctacgccttgaacactatcaccaacctaaaggtgcagttaatacgcatggctgaggcggagatggtgatccaccaccagcacgtccaggactgcgacgagagcgtgctgacgcgtctggaagcctggctaacagagcacgggtgtgatcgcctgaagcgtatggcagtttcaggggacgactgtgtggtgcgccccatcgacgatcggttcggactggcgctctcccacctgaacgccatgtcaaaagtgcgcaaggacatcagcgagtggcagccctccaagggttggaacgactgggagaatgtcccgttctgtagccaccactttcacgaactccagcttaaggacggccggcgcatcgtggtgccctgccgggagcaagatgagctgataggcagggggcgtgtttcccccggtaacgggtggatgatcaaggagaccgcgtgcttgagcaaggcctatgcgaacatgtggagtctcatgtactttcacaagcgggacatgcgcctactgtccctcgccgtttcttccgcggtacccacgagctgggtcccacagggccggacaacttggtccatccacgggaagggggagtggatgaccactgaggacatgctggaggtgtggaaccgagtgtggatcacgaacaacccccatatgcaggacaagacgatggtcaagaagtggcgggacgtgccgtacctaacaaagagacaggacaaactgtgtggaagccttatcggcatgaccaaccgggccacctgggcatctcacattcacttagtaatccaccgaatacggaccctaatcggccaggagaagtataccgactatttgaccgtaatggatcgctactctgtagacgccgacctgcagctcggtgagttgatc

SEQ ID NO: 320 - RNA, 303 nt, synthetic construct
  misc_feature 1..303: note = derived and/or modified CDS sequence (opt11) from YFV 17D__NC_002031.1__C
  source 1..303: mol_type = other RNA
atgagcgggcgcaaggcccagggcaagaccttgggcgtgaacatggtcaggcgcggggtcaggagcttgagcaataaaataaaacagaaaacgaaacagatcgggaacaggcccgggccctcgcgcggggtccagggctttatctttttctttctctttaacatactcacgggcaagaaaataaccgcgcacttgaaaaggctctggaaaatgctcgatccaaggcaagggctcgcggtcttgcgcaaggtcaagcgcgtggtcgcgagcttgatgaggggcttgagctcgcgcaagcgcagg

SEQ ID NO: 321 - RNA, 363 nt, synthetic construct
  misc_feature 1..363: note = derived and/or modified CDS sequence (opt11) from YFV 17D__NC_002031.1__C-ER anchor
  source 1..363: mol_type = other RNA
atgtccggccgcaaagcccaaggcaaaaccctcggcgtcaacatggtccgccgcggcgtccgctccctctccaacaaaatcaaacaaaaaaccaaacaaatcggcaaccgccccggcccctcccgcggcgtccaaggcttcatcttcttcttcctcttcaacatcctcaccggcaaaaaaatcaccgcccacctcaaacgcctctggaaaatgctcgacccccgccaaggcctcgccgtcctccgcaaagtcaaacgcgtcgtcgcctccctcatgcgcggcctctcctcccgcaaacgccgctcccacgacgtcctaaccgtccaattcctcatcctcggcatgctcctcatgaccggcggc

SEQ ID NO: 322 - RNA, 267 nt, synthetic construct
  misc_feature 1..267: note = derived and/or modified CDS sequence (opt11) from YFV 17D__NC_002031.1__pr
  source 1..267: mol_type = other RNA
gtcacgctcgtgcgcaagaacaggtggttgctcttgaacgtgacctcggaagatctcgggaaaacgttctcggtcgggaccgggaactgtaccacgaacatactcgaggccaagtactggtgcccggactcgatggagtacaattgcccgaacttgagcccgcgcgaggaaccggacgatatcgattgctggtgctatggcgtggaaaatgtcagggtcgcgtacgggaaatgtgactcggccgggcgctcgcgcaggagcaggcgc

SEQ ID NO: 323 - RNA, 225 nt, synthetic construct
  misc_feature 1..225: note = derived and/or modified CDS sequence (opt11) from YFV 17D__NC_002031.1__M
  source 1..225: mol_type = other RNA
gccatcgacctccccacccacgaaaaccacggcctcaaaacccgccaagaaaaatggatgaccggccgcatgggcgaacgccaactccaaaaaatcgaacgctggttcgtccgcaaccccttcttcgccgtcaccgccctcaccatcgcctacctcgtcggctccaacatgacccaacgcgtcgtcatcgccctcctcgtcctcgccgtcggccccgcctactcc

SEQ ID NO: 324 - RNA, 492 nt, synthetic construct
  misc_feature 1..492: note = derived and/or modified CDS sequence (opt11) from YFV 17D__NC_002031.1__prM
  source 1..492: mol_type = other RNA
gtcaccctcgtccgcaaaaaccgctggctcctcctcaacgtcacatccgaagacctcggcaaaacattctccgtcggcaccggcaactgcaccaccaacatcctcgaagccaaatactggtgccccgactccatggaatacaactgcccaaacctctccccccgcgaagaacccgacgacatcgactgctggtgctacggagtagaaaacgtccgcgtcgcctacggcaaatgcgactccgccggccgctcccgccgctcccgccgcgccatcgacctccccacccacgaaaaccacggcctcaaaacccgacaagaaaaatggatgaccggccgcatgggcgaacgccaactacaaaaaatcgaacgctggttcgtccgcaaccccttcttcgccgtcaccgccctcaccatcgcctacctcgtaggctccaacatgacccaacgcgtcgtcatcgcactcctagtactcgccgtcggcccagcctactcc

SEQ ID NO: 325 - RNA, 1479 nt, synthetic construct
  misc_feature 1..1479: note = derived and/or modified CDS sequence (opt11) from YFV 17D__NC_002031.1__E
  source 1..1479: mol_type = other RNA
gcgcactgcatcgggatcacagacagggacttcatcgagggcgtacacggaggcacatgggtgagcgccaccctggaacaggacaagtgcgtgaccgtcatggcgccagacaagccgagcctcgacataagcctagaaacagtagcgatcgaccgcccggcggaggtcaggaaagtgtgctacaatgcggtgctaacacacgtcaagataaacgacaaatgcccgagcacgggcgaggcacacctagcagaagagaacgaaggcgacaacgcgtgcaagagaacgtacagcgacaggggatggggaaacggctgcggcctgttcggtaaaggaagcatcgtcgcatgcgcgaaatttacctgcgccaagagcatgtccctattcgaggtcgaccaaacgaagatacaatacgtaataagagcacaactgcacgtcggcgccaaacaggaaaattggaacaccgacatcaagaccctaaaattcgacgccctatcgggctcgcaagaggtcgagttcataggttacggaaaggccacactagaatgccaggtccagacagccgttgacttcgggaacagctacatcgcagaaatggaaaccgagagctggatcgtcgacaggcaatgggcacaagacctgacactgccgtggcagtcaggctcaggcggagtctggcgcgagatgcaccacctggtcgagttcgaacccccacacgcagccacaatcagagtcctagcactgggaaaccaagagggcagcctcaaaaccgcgctcacaggcgcgatgagggtcacaaaagacaccaacgacaacaacctgtacaagctccacggcggacacgtaagttgccgcgtaaaactaagcgcgctaacgctcaagggcacgagctataagatatgcacagacaagatgttcttcgtgaaaaatccaacagacacaggccacggaacggtcgtgatgcaggtcaaagtctcgaaaggagccccatgccggataccggtcatagtagcagacgacctaacggcagcgatcaacaaaggcatactggtaaccgtcaacccaatcgcctcgaccaacgacgatgaagtactaatagaagtgaacccgcccttcggcgactcatacatcatagtcggacgcggggactcgcgactaacataccaatggcacaaggaaggaagctcgatcgggaaattgttcacgcaaacaatgaaaggcgtggagagactcgcagtcatgggcgacaccgcgtgggacttcagtagcgcgggcgggttcttcacctcagtcggaaaaggaatacacacagttttcggaagcgcattccaaggcttgttcgggggactgaactggatcacaaaggtgatcatgggagcagtcctaatctgggtcgggataaatacaagaaatatgacaatgagcatgagcatgatactcgtcggggtgataatgatgttcctaagcctgggcgtgggcgcg

SEQ ID NO: 326 - RNA, 1971 nt, synthetic construct
  misc_feature 1..1971: note = derived and/or modified CDS sequence (opt11) from YFV 17D__NC_002031.1__prME
  source 1..1971: mol_type = other RNA
gtgaccctagtccgcaaaaacagatggctactactaaacgtaacaagcgaagacctgggcaaaacattcagcgttggcacaggcaattgcacgacaaacatactcgaagcaaaatactggtgccccgacagcatggaatacaactgcccaaatctaagcccacgcgaagaaccagacgacatcgactgttggtgctacggagtcgaaaacgtgagggtcgcatacggtaaatgcgacagcgctggcagaagcagacgctcccgacgagccattgacctccctacccacgaaaaccacggcctaaaaacccggcaggaaaaatggatgacaggccggatgggagaacgccaactacagaaaatagagaggtggtttgtaagaaacccattcttcgccgtaaccgcgctcaccatcgcttacctcgtaggatcaaacatgacgcaaagagtagtgatcgcgctactcgtactagcggtaggccccgcctacagcgcacactgcatcggcatcactgacagggacttcatagaaggcgtccacgggggcacgtgggttagcgccacactcgaacaagacaaatgcgtcacagtgatggcaccagacaaaccctcactagacatctcactagaaaccgtcgcaatcgaccgcccagcagaagtcaggaaagtgtgctacaacgccgtcttaacccacgtaaaaataaatgataaatgcccaagcacgggagaggcacacctagcggaagaaaacgaaggcgacaacgcgtgcaaacgtacctacagcgacagagggtggggcaacggatgcggcttattcggaaaaggaagtatcgtagcatgcgcaaaatttacctgcgccaaaagcatgtccctattcgaagtagatcaaacaaaaatacaatacgtcatccgagcccaactacacgtgggggcaaaacaagaaaactggaacaccgacatcaaaacactcaaattcgatgccctaagcggctcccaagaagtagagttcatcggttacggcaaggccacgctcgagtgccaagtccaaacagcagtagacttcgggaactcatacatcgccgagatggaaacggaatcatggattgtcgacagacaatgggcacaagacctaacactaccatggcaatcaggcagcggaggggtctggcgagaaatgcaccacctagtagagttcgaacccccacacgccgcaacaatccgagtactagccctcggaaaccaagaaggatcactaaaaaccgcactcaccggcgcaatgcgcgtaacaaaagatacaaacgacaacaacctatacaaactacacggcggacacgtcagctgccgcgtcaaactatccgccctaacactaaaaggaacaagctacaaaatatgcacagacaaaatgttcttcgtcaaaaatccgactgacacgggccacggcacagtcgtaatgcaagtaaaagtctcaaaaggcgcaccatgcagaatcccagtaatcgtcgccgatgacctaacagccgcaatcaacaagggcatcctcgtaacagtaaaccccatagccagcaccaacgacgacgaagtcctaatcgaagtcaacccacccttcggagacagctacataatagtaggacgaggggactcacgcctaacctaccaatggcacaaagaaggatcctcaatcggcaaactgttcacacaaacgatgaaaggcgtagaaagactcgcagtaatgggcgatacggcctgggacttctcaagcgcgggcggcttcttcacgagcgtcggaaaaggcatccatacagtattcggaagcgcattccaaggcctatttggaggcctcaactggataacaaaagtgatcatgggagcagtactgatctgggtcggcatcaacacccgcaacatgacgatgagcatgtcaatgatcctcgtgggagtaataatgatgttcctcagcctgggcgtaggcgca

SEQ ID NO: 327 - RNA, 2031 nt, synthetic construct
  misc_feature 1..2031: note = derived and/or modified CDS sequence (opt11) from YFV 17D__NC_002031.1__ER anchor-prME
  source 1..2031: mol_type = other RNA
tcacacgacgtcctcaccgtgcaattcctcatcctcgggatgctactcatgaccggaggtgtaaccctggtaaggaaaaaccgctggctactgctgaacgtcacctccgaggacctcggaaagaccttctccgtaggtacagggaactgcacaaccaacatactggaggcgaaatactggtgccccgacagcatggaatacaactgcccaaacctatcccctagagaagaacccgacgacatagactgttggtgctacggggtagaaaacgtccgcgtggcctatgggaagtgcgatagcgcgggccggagcaggagatcaagacgagcaatcgacctaccaacgcacgaaaaccatggcctcaaaacacgacaggaaaagtggatgacaggccgaatgggcgaacgccagctccagaaaatagaaaggtggttcgtcagaaacccattcttcgcagtaaccgcactcacgatagcctacctggtcggcagcaacatgacgcaaagggtagtaatagccctcttggtcctggccgtaggccccgcatatagcgcccactgcataggcatcacggacagagacttcatagaaggcgtacatggaggaacatgggtatccgccaccctagagcaagacaagtgcgtaaccgtaatggcacccgacaaaccgagtctggacatatcgctcgaaacagtcgcgattgaccgaccggccgaagtcagaaaagtctgctacaacgccgtcttgacacacgtaaaaattaatgataaatgcccaagcaccggcgaggctcacctagctgaagaaaacgaaggagacaacgcatgcaaacgcacctacagtgaccggggctggggcaacggatgcggactcttcggaaaaggaagcattgtcgcatgcgccaaattcacctgtgccaaaagcatgagcttgttcgaggtagaccaaacgaaaatccaatacgtcatacgggcacaactccatgtgggagcaaaacaggaaaattggaacaccgacataaaaaccctgaaattcgacgccctctctggctcacaagaagtcgagttcataggatatggaaaagccactcttgaatgccaagtacaaacggccgtagacttcgggaacagctacatagccgaaatggagaccgaaagctggatcgtagacagacaatgggcccaggacctgacactaccatggcaatccggctccggcggggtctggagggaaatgcaccacctagtcgagttcgaacccccgcatgccgcaacaataagagtcctagccctcggaaaccaagagggaagtctcaagaccgcactaacgggtgcaatgcgagtaacaaaagacacaaacgacaacaacttgtacaaacttcacggcggacacgtaagctgccgagtgaagctgagcgcgctaacactcaaaggcacaagctacaaaatatgcacagacaagatgttcttcgtaaagaacccgacagacaccggacacggcacagtagtcatgcaagtcaaagtctccaaaggagccccatgccgaatacccgtaatcgtagcagacgacctcacagccgcgatcaacaaaggaatcctggtcacggtcaaccccatcgccagcaccaatgacgacgaggtactaatcgaagtaaacccgcccttcggcgacagctacataatcgtcggacgcggagacagcaggctcacctaccaatggcacaaggaagggtcatccatcggaaaactcttcacgcaaacaatgaaaggagtagaaaggctcgcagtcatgggagacacagcctgggacttctccagcgcgggaggattctttacctcggtcgggaaaggaatacacaccgtgttcgggagcgcattccagggcctattcggaggacttaactggatcacgaaagtgataatgggagcagtcctcatctgggtagggatcaacacacggaacatgaccatgagcatgtcaatgatactcgtcggcgtcataatgatgttcctcagcctcggcgtgggagca

SEQ ID NO: 328 - RNA, 1056 nt, synthetic construct
  misc_feature 1..1056: note = derived and/or modified CDS sequence (opt11) from YFV 17D__NC_002031.1__NS1
  source 1..1056: mol_type = other RNA
gaccagggctgcgccataaacttcggcaagcgcgaactcaagtgcggagacgggatcttcatcttccgcgacagcgatgactggctcaacaaatatagctactacccggaagaccccgtaaaactagcatcaatcgtgaaagcgagcttcgaagagggaaagtgcgggctaaacagcgtggactcgctcgagcacgagatgtggcgctcgcgcgcagacgagatcaacgccatattcgaggaaaatgaagtggacataagcgtggtagtgcaagaccccaagaacgtataccaacgagggacccaccccttcagcaggatcagggacggactccagtacggatggaagacctggggaaagaacctggtattcagcccaggaaggaaaaacggatcgttcataatcgatggaaagagcagaaaagagtgcccattctcgaacagagtatggaactcgttccagatcgaggagttcggaacgggcgtgttcacgacaagggtctacatggacgcagtattcgagtacacgatcgattgcgacggatcgatactgggcgcagccgtgaacgggaagaaaagcgcgcacgggagcccgacattttggatgggctcacacgaggtcaacggcacctggatgatccacaccctggaagcgctcgactacaaagaatgcgaatggcccctgacccacaccatcggaacgagcgtggaagaaagcgagatgttcatgccgcgatcaatcggaggcccggtctcaagccataaccacatcccgggatacaaagtgcaaacaaacgggccgtggatgcaggtcccgctagaagtcaaacgcgaggcctgccccgggacctcagtcattatagacggcaactgcgacggaaggggcaagagcacgcgatcgaccacagactcgggcaaggtcatacccgaatggtgctgccggagctgcacaatgcccccggtatcgttccacggatcggacgggtgctggtacccaatggaaatcaggcccaggaaaacacacgagagccacctcgtgcgctcgtgggtgaccgca

SEQ ID NO: 329 - RNA, 672 nt, synthetic construct
  misc_feature 1..672: note = derived and/or modified CDS sequence (opt11) from YFV 17D__NC_002031.1__NS2A
  source 1..672: mol_type = other RNA
ggcgaaatccacgccgtccccttcggcctagtctccatgatgatcgccatggaagtcgtcctccgaaaacgccaaggccccaaacaaatgctcgtcggcggcgtcgtcctcctaggagccatgctcgtcggccaagtcaccctcctcgacctccttaaactcaccgtcgccgtcggcctccacttccacgagatgaacaacggcggcgacgccatgtacatggcccttatagccgccttctccatccgccccggcctcctcataggcttcggcctccgcaccctctggtccccccgcgaacgcctggtcctcaccctaggcgccgccatggtcgaaatcgccctcggcggcgtcatgggcggcctctggaaatacctcaacgccgtctccctctgcatcctaaccatcaacgccgtcgccagccgcaaagccagcaacaccatcctccccctcatggccctcctcacacccgtcaccatggccgaagtccgcctcgccgcaatgttcttctgcgcggtcgtcatcataggcgtactccaccaaaacttcaaagacacatccatgcaaaaaaccatccccctagtagccctcacactcacctcctacctcggcctcacccaacccttcctcggcctctgcgccttcctagccacccgaatattcggccgcaga

SEQ ID NO: 330 - RNA, 390 nt, synthetic construct
  misc_feature 1..390: note = derived and/or modified CDS sequence (opt11) from YFV 17D__NC_002031.1__NS2B
  source 1..390: mol_type = other RNA
tcgatcccggtcaatgaagcgctcgcggccgcgggcttggtcggggtcttggccgggctcgcgttccaggaaatggaaaatttcttgggcccgatcgcggtcgggggcttgctcatgatgttggtctcggtcgcgggcagggtcgatggcttggaattgaaaaagctaggggaagtgagctgggaagaggaagcggaaataagcgggagctcggccaggtacgatgtcgcgctctcggaacagggcgagttcaagctcctgagcgaggaaaaggtcccgtgggatcaagtggtcatgacatcgctcgcgctagtgggcgcggccctgcacccgttcgcgctcttgctcgtgctcgcgggctggctatttcacgtgcgcggggccaggcgc

SEQ ID NO: 331 - RNA, 1869 nt, synthetic construct
  misc_feature 1..1869: note = derived and/or modified CDS sequence (opt11) from YFV 17D__NC_002031.1__NS3
  source 1..1869: mol_type = other RNA
tcgggagacgtattatgggacatcccaaccccaaaaatcatcgaagaatgtgaacacctagaggacgggatctacggcatattccaaagcacatttctaggcgccagccaacgaggggtaggggtcgcgcaaggcggcgtattccacacaatgtggcacgtcacccgaggagccttcctcgtacggaacgggaagaaactgatcccaagctgggccagcgtaaaagaggacctggtagcatacggcggcagttggaaactagaagggcgatgggacggcgaagaagaagtacaactcatagccgcagtacccggcaaaaacgtcgtcaacgtacaaacaaaaccgagcctcttcaaagtaagaaacggaggagagataggggcagtagccctagactacccctcaggaaccagcggcagcccaatcgtcaaccggaacggagaagtaatcgggctctacggcaacggaatcctagtaggagacaacagcttcgtctcagcaatctcgcaaacagaagtgaaagaagaaggaaaagaagaactacaagaaatcccaacaatgctcaaaaaggggatgacaaccgtactagacttccaccccggagccggaaaaacaagaagattcctcccgcaaatcctggccgagtgcgcacggcgccgcctaagaacgctagtactagcgccaacccgagtggtgctaagcgaaatgaaagaagcattccatggactcgacgtaaaattccacacacaagcattctcagcacacggcagtggcagagaagtcatcgacgcaatgtgccacgccaccctcacatacagaatgttagaaccaacacgggtagtcaactgggaagtaataatcatggacgaagcgcactttctagaccccgcgagcatcgcagcaagagggtgggccgcccaccgtgcacgcgccaacgagagtgcaaccatcctaatgactgcaacaccaccaggaacatcggacgagttcccacacagcaacggcgaaatcgaagacgtacagacggacataccaagcgaaccatggaacacaggccacgactggatcctagccgacaaaaggccaacagcctggttcttgccctcaatcagagcagccaacgtaatggccgcaagcctaagaaaagcaggcaaatccgtggtcgtcctcaaccgcaaaaccttcgaaagagaataccccaccatcaaacagaagaaacccgactttatactggccacagacatagcagaaatgggagcaaacctatgcgtagaaagagtactcgactgcagaactgcgttcaaacccgtcctagtagacgaaggaaggaaagtagccattaaaggacccctccgaatcagcgcaagcagtgcagcacagagacgcggacgcatcggacggaaccccaacagagacggcgacagctactactacagcgaacccacatcggaaaacaacgcccaccacgtatgctggctagaagcgagcatgctactagacaacatggaagtcaggggagggatggtcgccccactatacggcgtggagggaaccaaaacccccgtcagccccggagaaatgcgactccgagacgaccaacgcaaagtcttccgagaactggtacgaaattgcgacctaccagtatggttaagctggcaagtcgcgaaagccgggctgaaaaccaacgacagaaaatggtgcttcgagggaccagaagaacacgaaatcctcaacgactccggagaaaccgtcaaatgcagagcaccagggggcgccaagaaacccctacgcccacgctggtgcgacgaaagagtgagcagcgaccagagcgccctctcagagttcatcaaattcgcagaagggagaaga

SEQ ID NO: 332 - RNA, 447 nt, synthetic construct
  misc_feature 1..447: note = derived and/or modified CDS sequence (opt11) from YFV 17D__NC_002031.1__NS4A-P2K
  source 1..447: mol_type = other RNA
ggcgcggccgaggtcttggtcgtgctctcagaattgcccgacttcctggccaagaaagggggcgaggccatggacacgatctcggtatttctccacagcgaggaagggagccgggcctatcgcaatgccctgagcatgatgccggaagcgatgacgatcgtgatgttgttcatactcgcgggactgctcacgagcgggatggtgatctttttcatgagcccgaaagggatctcgcgcatgagcatggccatgggcacgatggcgggctgtggctatctcatgttcttgggcggagtcaagcccacgcacataagctatgtcatgctcatattctttgtcttgatggtggtcgtgatcccggaaccgggccagcaaaggagcatacaagataaccaggtcgcgtacttgatcataggaatactcacgctcgtgagcgcggtcgcggcc

SEQ ID NO: 333 - RNA, 750 nt, synthetic construct
  misc_feature 1..750: note = derived and/or modified CDS sequence (opt11) from YFV 17D__NC_002031.1__NS4B
  source 1..750: mol_type = other RNA
aacgaactaggcatgctcgaaaaaaccaaagaagacctcttcggcaaaaaaaacctcatcccatcctcagcctcaccctggtcctggccagacctcgatctaaaaccaggcgccgcctggaccgtctacgtcggcatcgtcaccatgctctccccaatgctccaccactggatcaaagtcgaatacggcaacctctctctatcaggcatagcccaatcagcctccgtactctcattcatggacaaaggcatccccttcatgaaaatgaacatctcagtcatcatgctcctcgtctcaggctggaactccatcaccgtaatgcccctcctctgcggaatcggctgcgccatgctccactggtccctcatcctccccggcattaaagcccaacaatccaaactcgcccaacgccgcgtctttcacggcgtcgccgaaaaccccgtagtcgacggcaacccaaccgtcgacatcgaagaagcccccgaaatgcccgccctatacgaaaaaaaactagccctctacctactcctcgccctctccttagcctccgtcgccatgtgccgcacacccttctccctagccgaaggaatcgtcctcgcatccgccgccctcggccccctcatcgaaggcaacacctccctcctctggaacggccccatggccgtctcaatgacaggcgtcatgcgcggcaaccactacgccttcgtcggcgtcatgtacaacctctggaaaatgaaaaccggccgccgc

SEQ ID NO: 334 - RNA, 2715 nt, synthetic construct
  misc_feature 1..2715: note = derived and/or modified CDS sequence (opt11) from YFV 17D__NC_002031.1__NS5
  source 1..2715: mol_type = other RNA
gggagcgctaacgggaaaacactgggcgaagtatggaaacgagaattaaacctactagacaaaagacagttcgaactctataagaggacggacatcgtagaagtcgaccgagacacggcaaggcgccacctcgcggaagggaaagtggacacaggagtggcagtgagcagagggaccgcaaaactaaggtggttccacgaaagagggtacgtgaagctagaaggacgagtgatcgacctaggctgcggacgaggcgggtggtgttactacgcggcagcacaaaaagaggtctcgggggtgaaggggttcacactgggccgagacggccacgaaaagccaatgaacgtccagagcctgggatggaacataataaccttcaaagacaaaaccgacatacacagactcgaacccgtaaaatgcgacaccctactctgtgacataggggaaagcagcagcagctcagtgacggaaggggaacgcacagtaagagtattagacaccgtcgagaagtggcttgcatgcggagtagacaacttctgcgtcaaagtgctcgcaccgtacatgccagacgtactggagaaactagaactactacagagaaggttcggaggaacggtgatacggaacccactgagcagaaacagcacgcacgaaatgtactacgttagtggggcacgaagcaacgtgacattcacggtgaaccaaaccagcagactactcatgcgacggatgcgccgaccaacgggaaaggtgacactagaggcagacgtcattctaccaatagggacaagaagcgtagaaacagacaagggaccgctcgataaggaggcaatagaggaaagagtagaacggattaagagtgagtacatgactagctggttctacgacaatgacaacccctaccggacatggcactattgtgggagttatgtgacgaaaacgtccggaagcgcggcaagcatggtgaacggagtaatcaagatactgacatacccatgggaccggatagaggaagtcacaaggatggcgatgacagacacaacgccgttcgggcagcaaagagtgttcaaagaaaaggtggacacgagggcgaaagacccgccggcaggaacgcgaaagatcatgaaagtagtgaataggtggctattccgacacctggcaagggagaagaacccaagactatgcaccaaggaggagttcatagcaaaagtaagatcgcatgccgcaataggggcgtacctcgaagaacaagaacagtggaagacagcaaacgaagcggtgcaggatccaaaattctgggaattagtggacgaagagagaaaactgcaccagcagggaaggtgcaggacatgcgtatacaacatgatgggaaaacgggagaagaaactcagcgagttcggcaaagcaaaagggagtcgcgcaatatggtacatgtggctaggggcaagatatttagagttcgaagcgctggggttcctcaacgaagaccactgggcgagccgggaaaacagtgggggtggggtcgaaggaatagggctacagtacctaggttacgtaatcagagatctagcagcaatggacggagggggattctacgcggacgacacagccgggtgggacacaaggataacagaggcggatctggacgacgagcaagaaatcctaaactacatgagcccacaccacaagaagttggcacaggcagtaatggagatgacctacaagaacaaggtcgtgaaagtattgaggccagcaccaggagggaaggcctacatggacgtgataagcagaagggaccagcgaggaagcggccaagtagtaacctacgccttaaacacaatcacaaacctcaaggtgcaactaatcaggatggcagaagcggaaatggtaatccaccatcaacacgtgcaagactgcgacgaaagtgtactgacgcgactcgaagcatggctcaccgagcacgggtgtgaccgcctgaaaagaatggcggtgagcggagacgactgcgtcgtgcgaccgatagatgacagattcggtctagcgttatcgcacctaaacgcaatgagtaaagtgagaaaggacataagcgaatggcagccgagcaaggggtggaacgactgggaaaacgtacccttctgcagccatcacttccacgaacttcaactaaaggacgggagaagaatagtagtgccatgcagagagcaagacgaactcataggccgcgggagggtgagtccaggaaacggatggatgataaaagagacggcgtgcctgagcaaggcgtacgccaacatgtggtcgctcatgtacttccacaaaagggacatgcgcctgctgagcctcgcggtaagcagcgcggtacctacgagctgggtgccacaaggccggacaacatggagtatacacggaaagggcgaatggatgacaacggaagatatgctagaggtgtggaacagagtatggatcacaaacaaccctcatatgcaggacaaaacaatggttaagaaatggagggatgtaccgtacctcaccaaaaggcaggacaaactatgtggatcgctgattggaatgacgaaccgggcgacatgggcaagccacatccacctagtaatacatcgaataaggacattgataggacaagagaaatatacagattacctaacagtgatggacaggtacagtgtagacgcagacttgcagctgggcgaactgata

SEQ ID NO: 335 - RNA, 2334 nt, synthetic construct
  misc_feature 1..2334: note = derived and/or modified CDS sequence (opt11) from YFV 17D__NC_002031.1__C-prME
  source 1..2334: mol_type = other RNA
atgtcgggcaggaaagcacaaggcaaaacgctaggagtaaatatggtcagacggggcgtacgcagcctatcaaacaagataaagcagaaaaccaaacaaatcggaaaccgacccggaccaagccggggcgtccaaggattcatcttcttctttctattcaacatactaaccggaaagaaaatcacagcgcacttaaaacgcctatggaaaatgctagacccccgccaaggactcgccgtgctaaggaaagtgaaacgagtcgtagcctccctgatgcgcggactgagcagcaggaaaagacgaagccacgacgtcctgacagtacaattccttattctcggaatgctactcatgacgggcggagtcaccctagtgaggaaaaaccgctggctcctgctcaacgtaacaagcgaagatctgggaaaaacattcagcgtcgggacaggaaactgcaccaccaacatcctagaagcaaaatactggtgccccgacagcatggaatacaactgccccaatctaagcccaagagaggaacccgacgacatagactgttggtgttacggggtcgaaaatgtcagagtcgcgtacggcaagtgcgactcggcaggcagaagccgaaggagtcgacgcgcaatcgacttgccgacccatgaaaaccacggcttaaaaacccgacaagaaaagtggatgacgggacgcatgggagagcgccaactccagaaaatagaacgatggttcgtgagaaacccgttcttcgcggtaaccgcactaacgatagcatacctcgtcgggtccaacatgacgcaaagggtagtgattgcactcctagtgctagccgtgggcccagcatactccgcacactgcataggcatcacagacagagacttcatcgagggagtgcacggaggcacatgggtaagcgcaaccctcgagcaagacaaatgcgtaacagtcatggcacccgacaaacccagcctagacataagcctcgaaacagtcgccatcgaccgcccagcagaagtacgcaaagtctgctacaacgcagtacttacgcacgtaaaaatcaacgacaaatgccctagcacaggcgaagcacacctcgcagaagaaaacgagggagacaacgcgtgcaagagaacgtactcagaccgaggctggggaaacggatgcggactattcgggaaaggaagcatcgtcgcatgcgcaaaattcacgtgcgcgaaaagcatgagcctctttgaagtagaccagaccaagattcaatacgtcataagagcgcaactgcacgtaggagcgaaacaggagaactggaacaccgacataaaaacactaaagttcgacgcactctcagggagtcaagaagtcgagttcataggatacggaaaggcaacactcgaatgccaagtccaaacagcagttgacttcgggaactcatacatagcggagatggaaacagagagctggatcgtcgacagacagtgggcccaggacttaacactaccctggcagagcggctcgggaggcgtctggcgcgagatgcaccacctggtcgagttcgaaccaccgcacgcagccacaatacgagtattggccctaggaaatcaagaaggctcgctcaaaacggcactaacaggagcaatgagggtcacgaaagacacaaacgacaataacttgtacaaactccatggcgggcacgtgtcatgccgcgtaaaactgagcgcgctcaccctaaaaggaaccagctacaaaatatgcacagacaagatgttctttgtcaaaaaccccactgacacaggacacggaacggtagtaatgcaagtcaaagtaagcaagggcgcaccatgccggataccggtcatagtcgcagacgacctaacagcggcaatcaataaaggtatactggtgacagtcaacccaatagccagcaccaacgacgacgaagtcctaatagaagtaaacccacccttcggcgactcctacatcatagtagggaggggagactcgcgattgacctaccaatggcacaaagaaggaagctcaataggcaagttgttcacacaaacgatgaagggagtagagaggctagccgtcatgggagatacagcatgggacttcagcagcgcaggcgggttcttcacatcagtgggtaaggggatacatacggtattcggcagcgccttccagggattgttcggaggcctaaactggatcaccaaagtcatcatgggggcagtcctaatatgggttggaataaacacacggaacatgacaatgagcatgagcatgatactcgtcggggtgataatgatgttcctgagcctcggagtaggtgct

SEQ ID NO: 336 - RNA, 3390 nt, synthetic construct
  misc_feature 1..3390: note = derived and/or modified CDS sequence (opt11) from YFV 17D__NC_002031.1__C-prME-NS1
  source 1..3390: mol_type = other RNA
atgtcgggacgcaaagcgcaaggcaaaacgctaggagtgaacatggtccgacgcggagtaaggagcctgagcaacaaaatcaaacagaaaacaaaacaaataggcaatcgcccgggcccgagcaggggcgtgcagggattcatattcttcttcttattcaacatcctcacaggaaagaaaataacggcccatctaaaacgactctggaaaatgttagacccaagacaaggcctcgctgtactcagaaaagtaaaacgcgtcgtcgcctcccttatgcggggactatcaagccgcaaaagacgatcacacgatgtactcacggtgcagttcctcatacttggaatgttgctaatgaccggaggagtaaccttagtacgaaagaaccgatggctgttactcaacgtcacgagcgaagacctaggcaaaaccttctcagttggaacgggtaattgcacgacaaacatactcgaagccaaatattggtgcccagactccatggaatataactgccccaatctaagcccacgagaggaacccgacgacatagattgctggtgctatggagtagaaaacgtacgcgtcgcatacggaaaatgcgactcagcgggccgctcacggcggtcacggagagcaatagacctacccacacatgagaaccacgggctaaaaactcgtcaggaaaaatggatgaccggccgcatgggcgagcgacaactacagaaaatagagaggtggttcgtaagaaacccatttttcgcggtcacagcactcacaatcgcatacctagtaggaagcaatatgacgcaaagggttgtaatagccctgctagtcctggccgtagggccggcatactccgcccactgcatcggtataacggatagggacttcatagaaggcgtacacggagggacatgggtaagcgcaacactagagcaggacaaatgcgtaaccgtcatggcacccgacaaaccgagcttggatatctcactcgaaaccgtcgcgatcgacagacccgcagaggtcagaaaagtatgctacaacgccgtcctgactcacgtaaaaatcaacgacaaatgccccagcactggagaggcacacctggccgaagagaacgaaggcgacaacgcatgcaaacgcacgtacagcgacagagggtggggcaacggctgcggcctgttcggcaaggggagcatagtagcctgcgcaaaattcacatgcgccaagagcatgtcgctgttcgaggtagaccaaaccaagatccaatacgtaatcagagcacagctacacgtgggtgcaaaacaggagaactggaacaccgacatcaaaaccctcaagttcgacgcgctcagtggctcacaagaagtagagttcataggatacggaaaagcaaccctggaatgccaagtccaaacagcagtagacttcgggaactcgtacatagccgagatggagaccgaaagctggatagtagatcgacaatgggcacaggacctcaccctaccgtggcaaagtgggagcggaggggtctggcgagaaatgcaccacctagtggaatttgagccgccacacgcagccacgatacgcgtgcttgcactgggcaaccaagaagggtctctaaaaaccgcccttacgggcgctatgagagtcacaaaagacacgaacgacaataacctgtacaagctacatgggggacatgtcagctgccgcgtcaaactcagcgcactcacgctcaaaggcacgagctacaagatatgcaccgacaaaatgttcttcgtcaaaaacccgacagacactgggcacgggacggtagtgatgcaagtcaaagtatcaaagggcgcaccatgccgcattccagttatagttgccgacgacctaacagccgcaatcaacaaaggcatcctagtcacggtaaacccgatagcatccaccaacgacgacgaagtactgatagaagtcaacccgccattcggagactcatacataatagtcggacggggcgacagccgcctaacctaccaatggcacaaggaaggcagctccatcggaaaattgttcacgcaaacaatgaaaggcgtcgaacgcctagcggtcatgggcgacacagcgtgggacttttccagcgcagggggcttcttcacgtccgtagggaaaggcattcacacggtgttcggaagcgcgttccaaggactgttcggcgggttgaactggatcacgaaagtgatcatgggtgcagtacttatatgggtgggaataaacacacgcaacatgacgatgtcaatgtcaatgatcctagtcggagtcataatgatgttcctcagcctaggcgtcggagcagaccagggctgcgccataaacttcggcaagcgcgaactaaagtgcggcgacggcatattcatcttccgcgactctgatgactggctgaacaaatacagctactacccagaggacccggtcaaattggcctccatagtaaaagctagctttgaggaagggaagtgcgggctcaacagcgtagacagcctcgaacacgagatgtggcgcagtcgtgcagatgaaataaacgcgatattcgaagaaaacgaagtcgacataagcgtggtagtacaggatccgaaaaacgtttaccaacgcggaacccacccattcagcagaatacgagacgggctgcaatacgggtggaaaacgtggggcaagaacctggtattcagccccggccgcaaaaacggcagcttcataatagacggcaaaagcagaaaagaatgccccttcagcaaccgtgtatggaatagcttccaaatcgaagagttcggaaccggtgtattcaccacccgagtctacatggacgcagtcttcgaatacacaatcgactgcgacggcagcatcctgggcgcagcagtaaatgggaagaaatcagcccacggtagcccaacattctggatgggcagccacgaagtaaacggaacgtggatgatccacacactggaagccctagactacaaagaatgcgagtggccattgacacacaccatcgggactagcgtcgaagagtcagagatgttcatgccgcgaagcatagggggcccggtatcaagccacaaccatatcccgggatacaaagtgcaaacgaacggcccgtggatgcaggtacccctcgaagtaaaacgagaagcctgcccaggcaccagcgtcataatagacggcaactgcgatggccggggaaaaagcacccgaagcaccacagactcgggaaaagtcatcccggaatggtgctgcagaagctgcacgatgccacctgtatcgtttcacggaagcgacgggtgctggtacccaatggaaatccgaccaaggaaaacacatgagagccatctagtccgatcctgggtcacagcg

SEQ ID NO: 337 - RNA, 30 nt, synthetic construct
  misc_feature 1..30: note = derived and/or modified CDS sequence (opt11) from YFV 17D__NC_002031.1__X or 10aa (5'-terminus)
  source 1..30: mol_type = other RNA
atgagggggttgagtagtaggaagaggagg

SEQ ID NO: 338 - RNA, 60 nt, synthetic construct
  misc_feature 1..60: note = derived and/or modified CDS sequence (opt11) from YFV 17D__NC_002031.1__SS or ER anchor (v1)
  source 1..60: mol_type = other RNA
tcccacgacgtcctcaccgtccaattcctcatcctcggcatgctcctcatgaccggcggc

SEQ ID NO: 339 - RNA, 54 nt, synthetic construct
  misc_feature 1..54: note = derived and/or modified CDS sequence (opt11) from YFV 17D__NC_002031.1__SS or ER anchor (v2)
  source 1..54: mol_type = other RNA
gacgtcctcaccgtccaattcctcatcctcggcatgctcctcatgaccggcggc

SEQ ID NO: 340 - RNA, 72 nt, synthetic construct
  misc_feature 1..72: note = derived and/or modified CDS sequence (opt11) from YFV 17D__NC_002031.1__SS or ER anchor (v4)
  source 1..72: mol_type = other RNA
tcccacgacgtcctcaccgtccaattcctcatcctcggcatgctcctcatgaccggcggcgtcaccctcgtc

SEQ ID NO: 341 - RNA, 90 nt, synthetic construct
  misc_feature 1..90: note = derived and/or modified CDS sequence (opt11) from YFV 17D__NC_002031.1__X-SS or 10aa (5'-terminus)-SS (v1)
  source 1..90: mol_type = other RNA
atgaggggcttgagctcgcgcaagcgcaggagccatgacgtgctcacggtccagttcttgatcttgggcatgctcttgatgacgggcggg

SEQ ID NO: 342 - RNA, 102 nt, synthetic construct
  misc_feature 1..102: note = derived and/or modified CDS sequence (opt11) from YFV 17D__NC_002031.1__X-SS or 10aa (5'-terminus)-SS (v2)
  source 1..102: mol_type = other RNA
atgcgcgggctctcgagcaggaaaaggcgctcgcacgatgtcttgaccgtgcaatttctcatactcgggatgttgctcatgaccgggggcgtgaccttggtc

SEQ ID NO: 343 - RNA, 30 nt, synthetic construct
  misc_feature 1..30: note = derived and/or modified CDS sequence (opt11) from YFV 17D__NC_002031.1__XX or 10aa (3'-terminus)
  source 1..30: mol_type = other RNA
gatcaagggtgcgcgatcaatttcgggaaa

SEQ ID NO: 344 - RNA, 2091 nt, synthetic construct
  misc_feature 1..2091: note = derived and/or modified CDS sequence (opt11) from YFV 17D__NC_002031.1__X-SS-prME-XX
  source 1..2091: mol_type = other RNA
atgcggggactaagcagcagaaaaagacgcagccacgatgtgctcaccgtgcaattcctcatactggggatgctcctaatgaccggaggcgtgaccctagtaaggaaaaacagatggctactactaaacgtaacctcagaagatctaggaaagacattttcagtcggcacaggcaactgcacaaccaacatactagaagcaaaatattggtgcccagacagcatggaatacaactgtcccaacctcagcccaagagaggaaccagacgacatagactgctggtgttacggagtagaaaacgtaagagtggcatacggcaaatgcgacagcgcaggcaggagccgaagatcccgcagagccatcgacttgcccacgcacgaaaaccacggcctcaaaacacgacaagaaaaatggatgacagggcgaatgggagaacgacagctccagaaaatagaacgatggttcgtccggaacccgttcttcgcagtaacggcactaacaatcgcatacctcgtaggcagcaacatgacacaaagagtggtcatcgcgctactcgtactagcagtggggcccgcatacagtgcacactgcataggaatcacagaccgtgacttcatcgaaggcgtacacggaggaacgtgggtaagcgcgacactggaacaagacaaatgcgtgacagtaatggcaccagacaaaccaagcctagacatatccctagaaacggtcgccatcgaccgtcccgcagaagtacgaaaggtatgctataatgcagtcctcacacacgtcaaaataaacgacaaatgccccagcacgggcgaagcacacctcgccgaagaaaacgaaggggataacgcgtgcaaacgcacctactccgacaggggatggggcaacggatgcggactgttcggaaaaggatccatagtcgcatgcgcaaaatttacctgcgcaaaaagcatgagcttgttcgaggtagaccaaacgaagatccaatacgtaatccgagctcaactacacgttggggccaagcaagagaactggaatacggacatcaaaacactaaaattcgacgcactctccggctcacaagaagtcgagttcatcggctacggcaaagcaacactagaatgccaagtacaaacagcggtggacttcggcaacagctacatagcagaaatggaaacagaaagctggatagtagaccgacaatgggcacaagacctaactctgccatggcaaagcggctcaggaggagtgtggagagagatgcaccacctggtagagttcgaacccccacacgcagcaacaataagggtactggcactaggcaaccaagaaggcagcctaaaaaccgcactcacaggagccatgcgcgtgacgaaggacaccaacgacaacaacctctacaaactccacggagggcacgtatcctgccgcgtaaaactatcagcactaacgctaaaaggaacaagctacaaaatatgcacagacaaaatgttcttcgtcaaaaaccccacagacacaggccacggcacagtcgtaatgcaagtgaaggtcagcaagggggccccctgccgaatcccagtcatagtggcagacgacctcacggccgccatcaacaaagggatcctggtaacagtgaacccaatagcatcgaccaacgacgacgaagtcctcatagaagtgaatcccccgttcggcgacagctacatcatcgtaggacgcggcgactcccgactgacgtaccaatggcataaagaaggcagcagcattggaaaactattcacccaaaccatgaagggcgtcgaaagactcgcggtgatgggagacaccgcatgggacttctcgagcgcaggcggcttcttcacaagcgtaggaaaagggattcacacagtattcggatccgcattccaaggcctcttcgggggactaaactggataacgaaagtaataatgggagcagttctcatatgggtaggaatcaacacacgaaacatgacaatgtccatgtcaatgatactcgtaggcgtaatcatgatgtttctgtcactcggagtgggagcagaccaaggttgcgccataaacttcggcaag

SEQ ID NO: 345 - RNA, 1581 nt, synthetic construct
  misc_feature 1..1581: note = derived and/or modified CDS sequence (opt11) from YFV 17D__NC_002031.1__X-SS-E
  source 1..1581: mol_type = other RNA
atgagaggactatcgagcaggaaacgacgatcgcacgacgtactgacagtgcaattcctcatactaggaatgctgctaatgacagggggcgtgacactggttgcacactgcatagggataacagacagggactttatcgagggcgtacacggaggcacgtgggtcagcgcaacactagaacaggacaagtgcgtgaccgtgatggcccccgacaaacccagcctggacataagcctagaaacagtcgcgatcgaccgcccggccgaagtcaggaaagtgtgttacaacgcggtactgacccacgtcaaaataaacgacaaatgcccaagcacgggcgaagcccacctagcagaagagaacgagggcgacaacgcatgcaaacgcacctactcggacagaggatggggaaacggctgcggcctattcgggaaagggagcatagtcgcatgtgcgaaatttacctgcgccaagagcatgtccctgttcgaagtagaccaaacaaaaatacaatacgtaataagagctcaactgcacgtcggagcgaaacaggaaaactggaacaccgacatcaagaccctgaaattcgacgcgttatcaggctcacaagaggtcgagtttataggctatggcaaggccacacttgaatgccaggtccagaccgcggtagacttcgggaactcatacatagcagagatggaaactgaaagctggatcgtagaccgacaatgggcacaggacctgaccctgccgtggcagtcaggctcgggaggagtctggcgagaaatgcatcacctggtagaatttgagcccccgcacgcggcaacaatcagggtcttagccttgggcaaccaagagggctcgctcaaaacagcgctcacaggcgcgatgcgggtcacgaaagacacaaacgacaacaacctgtacaaactacacggcggccacgtgtcatgccgcgtgaaactaagcgcgctcacgctcaagggaacaagctataaaatatgcacggacaagatgtttttcgtcaaaaacccaacagacacaggccacggcacggtagtgatgcaggtcaaggtctcaaaaggggccccgtgcagaataccagtgatagtcgcggacgacctcacagccgcgatcaacaaagggatcctggtcacagtaaaccccatagcctcaacgaacgacgacgaggtactcatagaagtgaacccgcccttcggagacagctacatcatagtaggacgaggggactcgcgcctgacctaccaatggcacaaggaagggagctcgatagggaaattattcacgcaaacaatgaaaggagtagaacggctcgccgttatgggagacaccgcgtgggacttctccagcgccggcggattctttaccagcgtagggaaagggatccacaccgtattcggaagcgcattccaaggcctgttcgggggcctcaactggatcacaaaagtgatcatgggtgcagtactgatttgggtcggaatcaacaccagaaacatgaccatgtccatgagcatgatactcgtaggggtcataatgatgttcctgagcctaggcgtgggcgcg

SEQ ID NO: 346 - RNA, 1611 nt, synthetic construct
  misc_feature 1..1611: note = derived and/or modified CDS sequence (opt11) from YFV 17D__NC_002031.1__X-SS-E-XX
  source 1..1611: mol_type = other RNA
atgcgcggactctcgtcaagaaagagacgctcgcacgacgtcctcaccgtacaattcctaatcctgggaatgctcctcatgacaggaggcgtaacgctcgtcgcccactgcatcgggatcacagaccgggacttcatcgaaggcgtacacggaggcacatgggtaagcgccaccctagaacaagacaaatgcgtaaccgtaatggcgccagacaaaccgagcctcgacataagcctagaaacggtcgcgatagaccgtccggcagaagtcaggaaagtatgctacaacgcggtactaacccacgtcaaaatcaacgacaaatgcccgagcactggggaggcacacctcgcagaagagaacgaaggcgacaacgcgtgcaaacgcacatactcggaccgaggctggggaaacggatgcggcctgttcgggaaaggcagcatagtcgcgtgcgccaaatttacctgcgccaaaagtatgagcctattcgaggtagaccaaaccaaaatccaatacgtaataagagcacaactgcacgtaggcgcaaaacaagaaaactggaacaccgacatcaaaaccctaaaattcgacgccctatcgggatcgcaagaagtcgagttcattggctacggcaaagctacgctagaatgccaagtacaaaccgcggtagacttcgggaactcatacatagccgaaatggaaaccgagagctggatcgtcgataggcaatgggcccaagacctgaccctaccctggcaatcggggtcgggcggggtctggcgcgagatgcatcacttagtcgagttcgaaccaccgcacgcggccaccatcagggtattagccctcggaaatcaagaaggatcactcaaaaccgcgctaacaggcgccatgcgggtaacaaaagacaccaacgacaataacctatacaaacttcacggcggacacgtaagctgccgcgtaaaactcagcgcactgaccctaaagggcacgagctacaaaatatgcacggacaaaatgttcttcgtaaagaacccaacagacaccggacacggaacggtagtaatgcaagtaaaggtatccaaaggagcaccatgcagaatcccagtcatagtcgccgacgacctcacagccgcaataaacaaagggatcctagtcactgtcaaccccatagcctccaccaacgacgacgaagtactaatagaagtcaacccacccttcggcgacagctacataatagtaggacgtggggactcccgcctcacctaccaatggcacaaagaaggaagctccatagggaagctgttcacccaaacaatgaaaggagtcgaaagactagccgtaatgggcgacaccgcatgggacttctcaagcgcgggcgggttcttcacctctgtaggcaagggcatccacaccgtgttcggaagcgcattccagggcctattcggaggcctgaactggatcacgaaagtaattatgggagcagtactaatctgggtcgggataaatacaagaaacatgactatgagtatgagcatgatcctcgtcggagtaataatgatgttcctaagcctcggtgtgggcgcagaccaaggctgcgccataaacttcggcaaa

SEQ ID NO: 347 - RNA, 2025 nt, synthetic construct
  misc_feature 1..2025: note = derived and/or modified CDS sequence (opt11) from YFV 17D__NC_002031.1__SS-prME
  source 1..2025: mol_type = other RNA
gacgtccttacggtacaattcctaatactaggaatgcttctcatgaccgggggcgtcaccctagtccggaaaaacagatggctactgctaaatgttacaagcgaagaccttggcaagacattcagcgtaggcacgggcaactgtacaaccaacatactagaagcgaaatactggtgcccagactccatggagtacaactgccccaacctaagcccacgggaagaacccgacgacatagactgctggtgttacggggtcgaaaacgtccgcgtcgcatacgggaaatgcgatagcgcaggccgcagtagacgctcccgccgcgccatagacctaccaacgcacgagaaccacggcctcaaaactcgccaagaaaaatggatgacagggcgaatgggtgaacgccaactacagaagatcgaaaggtggttcgtcaggaacccattcttcgcagtgaccgcactaacgatagcctacctagtgggatcaaacatgacgcaacgagtcgtgatcgcactcctagtactggccgtaggaccggcctactccgcgcactgcatcggcataacggatagggacttcattgaaggagtacatggcggcacgtgggtcagcgcgacactcgaacaagacaaatgcgtaaccgtgatggcacccgacaaaccgagtcttgacataagcctggaaacggtagcgatagatcgtccagccgaagtaagaaaagtatgctacaacgcagtcctaacacacgtaaaaataaacgacaaatgcccaagcacaggggaagcccacctcgcagaagagaacgaaggcgacaacgcatgcaaacgcacatactccgacaggggatgggggaatggctgcggactattcgggaaaggaagcatcgtcgcgtgcgccaaattcacatgcgccaagagcatgagcctgttcgaagtcgaccaaacaaaaatccaatacgtaatacgcgcgcaactgcacgtaggagcgaaacaggaaaactggaacacggacattaaaaccctcaaattcgacgcgctctcaggatcacaagaagtcgagttcatcggctacggcaaggcaacgctcgaatgccaagtacaaacagcagtagacttcggaaacagctacattgccgagatggaaaccgagagctggatagtcgacagacaatgggcccaagacctaaccctgccatggcaatcaggctccgggggcgtctggcgagagatgcaccacctagtagagttcgaaccaccccacgccgccacgatcagagtactggccctgggcaaccaagaaggctcactcaagacggcgctcacaggagcaatgagggtcacgaaagacaccaacgacaacaacctctacaaactacacggagggcacgtgagctgccgggtaaaactgagcgcactcactctgaagggaacaagctacaagatatgcaccgacaaaatgttcttcgtgaaaaacccaaccgacactggacacggcacggtcgttatgcaagtcaaggtatcaaaaggagccccatgcagaatcccagtaatagtagcggacgacctaacagccgccataaacaaaggaatcctagtcacggtaaatccgatagcatcgaccaacgacgacgaagtactaatagaagtgaacccaccattcggcgacagctacataatagtcgggagaggcgactcgcgactaacctaccaatggcacaaggaagggagctctatcgggaaactattcacccaaacgatgaagggcgtagaaaggctcgcagtcatgggcgacaccgcatgggacttctccagcgcgggaggcttctttacttcagtgggaaaagggatacacaccgtcttcggcagcgcattccagggcctattcggcgggttaaactggatcacgaaagtgataatgggggcagttctcatctgggtcggaataaacacacgtaacatgaccatgagcatgagcatgatcctagtcggggtcataatgatgttcttgagcttgggagtaggtgca

SEQ ID NO: 348 - RNA, 3081 nt, synthetic construct
  misc_feature 1..3081: note = derived and/or modified CDS sequence (opt11) from YFV 17D__NC_002031.1__SS-prME-NS1
  source 1..3081: mol_type = other RNA
gacgtactgaccgtacaattcctcatcctcggcatgctactcatgaccgggggcgtaactttggtccgcaaaaatcggtggctcctcctaaacgtcacatcagaagacctcgggaaaacgttcagcgtaggaacaggaaattgcacgaccaacatcctcgaagcgaaatactggtgcccagacagcatggaatacaactgtcccaacctcagcccccgggaagaacccgacgacatcgactgctggtgttacggagtcgagaacgtccgcgtggcctacggcaaatgcgactccgcaggccggagtagaagatcacgtcgcgcgatcgacctgcccacacatgaaaaccacggattaaaaacccgacaggaaaagtggatgaccgggagaatgggagaaagacaactccagaaaatagaaagatggttcgtccgaaacccgttctttgcagtaaccgccctcacaatagcatacctcgtcgggagcaacatgacccaacgggtcgtgatcgccctcctagtactagcggtcggaccagcgtacagcgcacactgcataggcataacagatcgtgacttcatagagggagtacatggtgggacatgggtgtccgcaaccttagaacaagacaaatgcgtcaccgtcatggcgcccgacaagcccagcttagacatatccctggaaacggtggccatcgacagaccggccgaagtgcgcaaagtatgctacaacgcggtactcacccacgtcaaaataaacgacaaatgcccaagcacaggagaggcacacctggccgaagagaacgaaggcgacaacgcgtgcaagcgaacatactcagacagaggatgggggaacggctgcggcctattcggaaagggaagcatagtagcgtgtgcaaaatttacctgcgccaagagcatgagtttgttcgaggtcgaccaaacaaaaatccaatacgtgatccgagcacaactgcacgtaggcgcaaaacaagaaaactggaacaccgacataaagacactgaaattcgacgcactgagtggctctcaggaggtcgagttcataggctacgggaaggcaacactcgaatgccaagtccaaaccgcggtagatttcgggaacagctacatcgcagaaatggaaacagaaagctggatcgtggaccgccaatgggcccaagacctaaccctaccctggcagtcaggcagtggcggcgtctggcgagaaatgcaccatctcgtggagttcgaaccaccccacgccgccacgatcagagtcctcgccctcggtaaccaggagggatccctaaagacagcactgaccggagcgatgcgtgtaacaaaagacaccaatgataacaacctatacaaactgcacggcgggcacgtgagttgccgcgtgaaactaagcgcgcttacactcaaaggcacaagctacaaaatatgcacggacaaaatgttcttcgtcaagaacccaaccgacacgggccatggaaccgtcgtaatgcaagtcaaggtatcgaaaggcgcaccgtgcagaataccagtgatagtggcggatgacctcaccgcagcaatcaacaaaggcatcctggtcacagtcaacccaatagcctccacgaacgacgacgaagtcctgattgaggtaaacccaccgttcggagacagctacatcatagtcggacgcggagacagtcgcttaacataccagtggcacaaagaagggagctcaataggaaagttattcacgcaaactatgaaaggagtagaacgactagcggtaatgggcgacacagcgtgggacttctcaagcgcgggtggctttttcacatcggtagggaaaggcatccatacagtattcggaagcgccttccagggtttattcggcgggctgaattggatcacaaaagtaatcatgggcgcggtcttaatctgggtgggcatcaacacccgaaacatgacaatgagcatgagcatgatcctagtcggcgtcatcatgatgttcctctccctgggcgtgggcgcagaccagggatgcgccatcaacttcggaaagcgcgagctaaagtgcggcgacggcatcttcatattcagggatagcgacgactggctaaacaaatactcctattatccagaagaccccgtcaaactagcctcaatcgtgaaagcgagcttcgaggaaggcaaatgcgggctaaactcagtagactcactcgaacatgaaatgtggagatcaagagcagacgagatcaacgcaatcttcgaagaaaacgaagtcgacatcagcgtggtcgtccaagaccccaaaaacgtgtaccaacgcggaacccaccccttcagccggatccgcgacggactacaatacgggtggaaaacatggggcaagaacctcgttttcagccccggacggaagaacggctccttcatcatcgacggaaaaagcagaaaagagtgcccattctcaaaccgagtctggaactctttccaaatcgaagagttcgggacaggcgtcttcacgacccgcgtatacatggacgccgtgttcgagtacacaatagactgcgacggatcaatattaggagcagccgtgaacggaaagaaaagcgcacacggatcacctacattctggatgggctcacacgaggtcaacggcacatggatgatacacaccctagaggccctcgactacaaagaatgcgagtggcctctaacccataccatcggaacaagcgtggaagagtccgagatgtttatgccaaggtcgatcgggggcccagtgtccagccataaccacataccagggtacaaagtgcaaacaaacggtccgtggatgcaggtaccactagaggtcaagcgggaagcatgccccgggacatcagtcataatcgacggcaactgcgatggcagaggcaaaagcacacgttccaccacggactcaggaaaagtaataccagaatggtgctgcagaagttgcacaatgcccccagtaagtttccatggatccgacggatgctggtacccaatggaaatcagacctcggaaaacgcacgagagccatctggtcagaagctgggtcaccgca

SEQ ID NO: 349 - RNA, 273 nt, synthetic construct
  misc_feature 1..273: note = derived and/or modified CDS sequence (opt11) from YFV 17D__NC_002031.1__C (without X-SS)
  source 1..273: mol_type = other RNA
atgagcgggcgcaaggcccagggcaagaccttgggcgtgaacatggtcaggcgcggggtcaggagcttgagcaataaaataaaacagaaaacgaaacagatcgggaacaggcccgggccctcgcgcggggtccagggctttatctttttctttctctttaacatactcacgggcaagaaaataaccgcgcacttgaaaaggctctggaaaatgctcgatcccaggcaagggctcgcggtcttgcgcaaggtcaagcgcgtggtcgcgagcttg

SEQ ID NO: 350 - RNA, 1026 nt, synthetic construct
  misc_feature 1..1026: note = derived and/or modified CDS sequence (opt11) from YFV 17D__NC_002031.1__NS1 (without XX)
  source 1..1026: mol_type = other RNA
agagagctcaagtgcggagacggaatcttcatattccgcgatagcgatgactggctcaataaatacagctactacccggaagaccccgtgaaactagcctcgatcgtaaaagcgagcttcgaagagggcaagtgcggactcaacagcgtggactcgctcgagcacgagatgtggcgctcacgagcagacgagatcaacgcaatattcgaggaaaacgaagtggacataagcgtagtagtgcaagaccccaaaaacgtgtaccagcgcggaacccacccattcagcagaatcagggacgggctccagtacgggtggaagacatggggcaagaacctggttttcagcccgggcaggaaaaacggctcattcataatcgacggcaagagcagaaaagagtgcccgttctcgaacagagtctggaactcgttccaaatcgaggaatttggcacgggagtattcacgaccagagtctacatggacgccgtgttcgagtacaccatcgactgcgacggaagcatcctaggagcggcggtgaacgggaaaaagagcgcacacggaagcccaaccttttggatgggctcacacgaggtcaacggaacgtggatgatacacaccctagaagcactagactacaaggaatgcgaatggcccctaacccacaccataggaacaagcgtggaagaaagtgagatgttcatgccgcgatcgatcgggggcccggtatctagccacaaccacatcccaggctacaaagtgcaaacgaacgggccctggatgcaggtcccgctcgaggtaaagcgcgaggcctgccccggaacatcagtcatcatcgacggcaactgcgacggcagaggcaagagcacgcgctcgaccacggactcgggaaaggtaataccagagtggtgctgcagaagctgcacaatgcccccggtatcattccacggctccgacggatgctggtacccgatggagatcagacccaggaaaacacacgagagccacctagtgcgctcatgggtaaccgca

SEQ ID NO: 351 - RNA, 2334 nt, synthetic construct; identical to SEQ ID NO: 175
  misc_feature 1..2334: note = derived and/or modified CDS sequence (opt16) from YFV 17D__NC_002031.1__C-prME
  source 1..2334: mol_type = other RNA

SEQ ID NO: 352 - RNA, 3390 nt, synthetic construct; identical to SEQ ID NO: 176
  misc_feature 1..3390: note = derived and/or modified CDS sequence (opt16) from YFV 17D__NC_002031.1__C-prME-NS1
  source 1..3390: mol_type = other RNA

SEQ ID NO: 353 - RNA, 30 nt, synthetic construct; identical to SEQ ID NO: 177
  misc_feature 1..30: note = derived and/or modified CDS sequence (opt16) from YFV 17D__NC_002031.1__X or 10aa (5'-terminus)
  source 1..30: mol_type = other RNA

SEQ ID NO: 354 - RNA, 60 nt, synthetic construct; identical to SEQ ID NO: 178
  misc_feature 1..60: note = derived and/or modified CDS sequence (opt16) from YFV 17D__NC_002031.1__SS or ER anchor (v1)
  source 1..60: mol_type = other RNA

SEQ ID NO: 355 - RNA, 54 nt, synthetic construct; identical to SEQ ID NO: 179
  misc_feature 1..54: note = derived and/or modified CDS sequence (opt16) from YFV 17D__NC_002031.1__SS or ER anchor (v2)
  source 1..54: mol_type = other RNA

SEQ ID NO: 356 - RNA, 72 nt, synthetic construct; identical to SEQ ID NO: 180
  misc_feature 1..72: note = derived and/or modified CDS sequence (opt16) from YFV 17D__NC_002031.1__SS or ER anchor (v4)
  source 1..72: mol_type = other RNA

SEQ ID NO: 357 - RNA, 90 nt, synthetic construct; identical to SEQ ID NO: 181
  misc_feature 1..90: note = derived and/or modified CDS sequence (opt16) from YFV 17D__NC_002031.1__X-SS or 10aa (5'-terminus)-SS (v1)
  source 1..90: mol_type = other RNA

SEQ ID NO: 358 - RNA, 102 nt, synthetic construct; identical to SEQ ID NO: 182
  misc_feature 1..102: note = derived and/or modified CDS sequence (opt16) from YFV 17D__NC_002031.1__X-SS or 10aa (5'-terminus)-SS (v2)
  source 1..102: mol_type = other RNA

SEQ ID NO: 359 - RNA, 30 nt, synthetic construct; identical to SEQ ID NO: 117
  misc_feature 1..30: note = derived and/or modified CDS sequence (opt16) from YFV 17D__NC_002031.1__XX or 10aa (3'-terminus)
  source 1..30: mol_type = other RNA

SEQ ID NO: 360 - RNA, 2091 nt, synthetic construct; identical to SEQ ID NO: 184
  misc_feature 1..2091: note = derived and/or modified CDS sequence (opt16) from YFV 17D__NC_002031.1__X-SS-prME-XX
  source 1..2091: mol_type = other RNA

SEQ ID NO: 361 - RNA, 1581 nt, synthetic construct; identical to SEQ ID NO: 185
  misc_feature 1..1581: note = derived and/or modified CDS sequence (opt16) from YFV 17D__NC_002031.1__X-SS-E
  source 1..1581: mol_type = other RNA

SEQ ID NO: 362 - RNA, 1611 nt, synthetic construct; identical to SEQ ID NO: 186
  misc_feature 1..1611: note = derived and/or modified CDS sequence (opt16) from YFV 17D__NC_002031.1__X-SS-E-XX
  source 1..1611: mol_type = other RNA

SEQ ID NO: 363 - RNA, 2025 nt, synthetic construct; identical to SEQ ID NO: 187
  misc_feature 1..2025: note = derived and/or modified CDS sequence (opt16) from YFV 17D__NC_002031.1__SS-prME
  source 1..2025: mol_type = other RNA

SEQ ID NO: 364 - RNA, 3081 nt, synthetic construct; identical to SEQ ID NO: 188
  misc_feature 1..3081: note = derived and/or modified CDS sequence (opt16) from YFV 17D__NC_002031.1__SS-prME-NS1
  source 1..3081: mol_type = other RNA

SEQ ID NO: 365 - RNA, 30 nt, synthetic construct
  misc_feature 1..30: note = derived and/or modified CDS sequence (opt17) from YFV 17D__NC_002031.1__X or 10aa (5'-terminus)
  source 1..30: mol_type = other RNA
atgcggggcctctcctcccggaagcggcgg

SEQ ID NO: 366 - RNA, 60 nt, synthetic construct; identical to SEQ ID NO: 178
  misc_feature 1..60: note = derived and/or modified CDS sequence (opt17) from YFV 17D__NC_002031.1__SS or ER anchor (v1)
  source 1..60: mol_type = other RNA

SEQ ID NO: 367 - RNA, 54 nt, synthetic construct; identical to SEQ ID NO: 179
  misc_feature 1..54: note = derived and/or modified CDS sequence (opt17) from YFV 17D__NC_002031.1__SS or ER anchor (v2)
  source 1..54: mol_type = other RNA

SEQ ID NO: 368 - RNA, 72 nt, synthetic construct; identical to SEQ ID NO: 180
  misc_feature 1..72: note = derived and/or modified CDS sequence (opt17) from YFV 17D__NC_002031.1__SS or ER anchor (v4)
  source 1..72: mol_type = other RNA

SEQ ID NO: 369 - RNA, 90 nt, synthetic construct
  misc_feature 1..90: note = derived and/or modified CDS sequence (opt17) from YFV 17D__NC_002031.1__X-SS or 10aa (5'-terminus)-SS (v1)
  source 1..90: mol_type = other RNA
atgcggggcctctcctcccggaagcggcggtcccacgacgtcctcaccgtccagttcctcatcctcggcatgctcctcatgaccggcggc

SEQ ID NO: 370 - RNA, 102 nt, synthetic construct
  misc_feature 1..102: note = derived and/or modified CDS sequence (opt17) from YFV 17D__NC_002031.1__X-SS or 10aa (5'-terminus)-SS (v2)
  source 1..102: mol_type = other RNA
atgcggggcctctcctcccggaagcggcggtcccacgacgtcctcaccgtccagttcctcatcctcggcatgctcctcatgaccggcggcgtcaccctcgtc

SEQ ID NO: 371 - RNA, 30 nt, synthetic construct; identical to SEQ ID NO: 117
  misc_feature 1..30: note = derived and/or modified CDS sequence (opt17) from YFV 17D__NC_002031.1__XX or 10aa (3'-terminus)
  source 1..30: mol_type = other RNA

SEQ ID NO: 372 - RNA, 2091 nt, synthetic construct
  misc_feature 1..2091: note = derived and/or modified CDS sequence (opt17) from YFV 17D__NC_002031.1__X-SS-prME-XX
  source 1..2091: mol_type = other RNA
atgcggggcctctcctcccggaagcggcggtcccacgacgtcctcaccgtccagttcctcatcctcggcatgctcctcatgaccggcggcgtcaccctcgtccggaagaaccggtggctcctcctcaacgtcacctccgaggacctcggcaagaccttctccgtcggcaccggcaactgcaccaccaacatcctcgaggccaagtactggtgccccgactccatggagtacaactgccccaacctctccccccgggaggagcccgacgacatcgactgctggtgctacggcgtcgagaacgtccgggtcgcctacggcaagtgcgactccgccggccggtcccggcggtcccggcgggccatcgacctccccacccacgagaaccacggcctcaagacccggcaggagaagtggatgaccggccggatgggcgagcggcagctccagaagatcgagcggtggttcgtccggaaccccttcttcgccgtcaccgccctcaccatcgcctacctcgtcggctccaacatgacccagcgggtcgtcatcgccctcctcgtcctcgccgtcggccccgcctactccgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgccgaccagggctgcgccatcaacttcggcaag

SEQ ID NO: 373 - RNA, 1581 nt, synthetic construct
  misc_feature 1..1581: note = derived and/or modified CDS sequence (opt17) from YFV 17D__NC_002031.1__X-SS-E
  source 1..1581: mol_type = other RNA
atgcggggcctctcctcccggaagcggcggtcccacgacgtcctcaccgtccagttcctcatcctcggcatgctcctcatgaccggcggcgtcaccctcgtcgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgcc

SEQ ID NO: 374 - RNA, 1611 nt, synthetic construct
  misc_feature 1..1611: note = derived and/or modified CDS sequence (opt17) from YFV 17D__NC_002031.1__X-SS-E-XX
  source 1..1611: mol_type = other RNA
atgcggggcctctcctcccggaagcggcggtcccacgacgtcctcaccgtccagttcctcatcctcggcatgctcctcatgaccggcggcgtcaccctcgtcgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgccgaccagggctgcgccatcaacttcggcaag

SEQ ID NO: 375 - RNA, 10453 nt, synthetic construct
  misc_feature 1..10453: note = mRNA product Design1 comprising derived and/or modified sequence from YFV 17D__NC_002031.1__polyprotein (CDS wt)
  source 1..10453: mol_type = other RNA
gggagaaagcttaccatgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagcttgcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccagaattcgggatggtctgcagtatggttggaagacttggggtaagaaccttgtgttctccccagggaggaagaatggaagcttcatcatagatggaaagtccaggaaagaatgcccgttttcaaaccgggtctggaattctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcttgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagctggagaaatacatgctgtcccttttggtttggtgagcatgatgatagcaatggaagtggtcctaaggaaaagacagggaccaaagcaaatgttggttggaggagtagtgctcttgggagcaatgctggtcgggcaagtaactctccttgatttgctgaaactcacagtggctgtgggattgcatttccatgagatgaacaatggaggagacgccatgtatatggcgttgattgctgccttttcaatcagaccagggctgctcatcggctttgggctcaggaccctatggagccctcgggaacgccttgtgctgaccctaggagcagccatggtggagattgccttgggtggcgtgatgggcggcctgtggaagtatctaaatgcagtttctctctgcatcctgacaataaatgctgttgcttctaggaaagcatcaaataccatcttgcccctcatggctctgttgacacctgtcactatggctgaggtgagacttgccgcaatgttcttttgtgccgtggttatcataggggtccttcaccagaatttcaaggacacctccatgcagaagactatacctctggtggccctcacactcacatcttacctgggcttgacacaaccttttttgggcctgtgtgcatttctggcaacccgcatatttgggcgaaggagtatcccagtgaatgaggcactcgcagcagctggtctagtgggagtgctggcaggactggcttttcaggagatggagaacttccttggtccgattgcagttggaggactcctgatgatgctggttagcgtggctgggagggtggatgggctagagctcaagaagcttggtgaagtttcatgggaagaggaggcggagatcagcgggagttccgcccgctatgatgtggcactcagtgaacaaggggagttcaagctgctttctgaagagaaagtgccatgggaccaggttgtgatgacctcgctggccttggttggggctgccctccatccatttgctcttctgctggtccttgctgggtggctgtttcatgtcaggggagctaggagaagtggggatgtcttgtgggatattcccactcctaagatcatcgaggaatgtgaacatctggaggatgggatttatggcatattccagtcaaccttcttgggggcctcccagcgaggagtgggagtggcacagggaggggtgttccacacaatgtggcatgtcacaagaggagctttccttgtcaggaatggcaagaagttgattccatcttgggcttcagtaaaggaagaccttgtcgcctatggtggctcatggaagttggaaggcagatgggatggagaggaagaggtccagttgatcgcggctgttccaggaaagaacgtggtcaacgtccagacaaaaccgagcttgttcaaagtgaggaatgggggagaaatcggggctgtcgctcttgactatccgagtggcacttcaggatctcctattgttaacaggaacggagaggtgattgggctgtacggcaatggcatccttgtcggtgacaactccttcgtgtccgccatatcccagactgaggtgaaggaagaaggaaaggaggagctccaagagatcccgacaatgctaaagaaaggaatgacaactgtccttgattttcatcctggagctgggaagacaagacgtttcctcccacagatcttggccgagtgcgcacggagacgcttgcgcactcttgtgttggcccccaccagggttgttctttctgaaatgaaggaggcttttcacggcctggacgtgaaattccacacacaggctttttccgctcacggcagcgggagagaagtcattgatgccatgtgccatgccaccctaacttacaggatgttggaaccaactagggttgttaactgggaagtgatcattatggatgaagcccattttttggatccagctagcatagccgctagaggttgggcagcgcacagagctagggcaaatgaaagtgcaacaatcttgatgacagccacaccgcctgggactagtgatgaatttccacattcaaatggtgaaatagaagatgttcaaacggacatacccagtgagccctggaacacagggcatgactggatcctagctgacaaaaggcccacggcatggttccttccatccatcagagctgcaaatgtcatggctgcctctttgcgtaaggctggaaagagtgtggtggtcctgaacaggaaaacctttgagagagaataccccacgataaagcagaagaaacctgactttatattggccactgacatagctgaaatgggagccaacctttgcgtggagcgagtgctggattgcaggacggcttttaagcctgtgcttgtggatgaagggaggaaggtggcaataaaagggccacttcgtatctccgcatcctctgctgctcaaaggagggggcgcattgggagaaatcccaacagagatggagactcatactactattctgagcctacaagtgaaaataatgcccaccacgtctgctggttggaggcctcaatgctcttggacaacatggaggtgaggggtggaatggtcgccccactctatggcgttgaaggaactaaaacaccagtttcccctggtgaaatgagactgagggatgaccagaggaaagtcttcagagaactagtgaggaattgtgacctgcccgtttggctttcgtggcaagtggccaaggctggtttgaagacgaatgatcgtaagtggtgttttgaaggccctgaggaacatgagatcttgaatgacagcggtgaaacagtgaagtgcagggctcctggaggagcaaagaagcctctgcgcccaaggtggtgtgatgaaagggtgtcatctgaccagagtgcgctgtctgaatttattaagtttgctgaaggtaggaggggagctgctgaagtgctagttgtgctgagtgaactccctgatttcctggctaaaaaaggtggagaggcaatggataccatcagtgtgttcctccactctgaggaaggctctagggcttaccgcaatgcactatcaatgatgcctgaggcaatgacaatagtcatgctgtttatactggctggactactgacatcgggaatggtcatctttttcatgtctcccaaaggcatcagtagaatgtctatggcgatgggcacaatggccggctgtggatatctcatgttccttggaggcgtcaaacccactcacatctcctatgtcatgctcatattctttgtcctgatggtggttgtgatccccgagccagggcaacaaaggtccatccaagacaaccaagtggcatacctcattattggcatcctgacgctggtttcagcggtggcagccaacgagctaggcatgctggagaaaaccaaagaggacctctttgggaagaagaacttaattccatctagtgcttcaccctggagttggccggatcttgacctgaagccaggagctgcctggacagtgtacgttggcattgttacaatgctctctccaatgttgcaccactggatcaaagtcgaatatggcaacctgtctctgtctggaatagcccagtcagcctcagtcctttctttcatggacaaggggataccattcatgaagatgaatatctcggtcataatgctgctggtcagtggctggaattcaataacagtgatgcctctgctctgtggcatagggtgcgccatgctccactggtctctcattttacctggaatcaaagcgcagcagtcaaagcttgcacagagaagggtgttccatggcgttgccgagaaccctgtggttgatgggaatccaacagttgacattgaggaagctcctgaaatgcctgccctttatgagaagaaactggctctatatctccttcttgctctcagcctagcttctgttgccatgtgcagaacgcccttttcattggctgaaggcattgtcctagcatcagctgccttagggccgctcatagagggaaacaccagccttctttggaatggacccatggctgtctccatgacaggagtcatgagggggaatcactatgcttttgtgggagtcatgtacaatctatggaagatgaaaactggacgccgggggagcgcgaatggaaaaactttgggtgaagtctggaagagggaactgaatctgttggacaagcgacagtttgagttgtataaaaggaccgacattgtggaggtggatcgtgatacggcacgcaggcatttggccgaagggaaggtggacaccggggtggcggtctccagggggaccgcaaagttaaggtggttccatgagcgtggctatgtcaagctggaaggtagggtgattgacctggggtgtggccgcggaggctggtgttactacgctgctgcgcaaaaggaagtgagtggggtcaaaggatttactcttggaagagacggccatgagaaacccatgaatgtgcaaagtctgggatggaacatcatcaccttcaaggacaaaactgatatccaccgcctagaaccagtgaaatgtgacacccttttgtgtgacattggagagtcatcatcgtcatcggtcacagagggggaaaggaccgtgagagttcttgatactgtagaaaaatggctggcttgtggggttgacaacttctgtgtgaaggtgttagctccatacatgccagatgttctcgagaaactggaattgctccaaaggaggtttggcggaacagtgatcaggaaccctctctccaggaattccactcatgaaatgtactacgtgtctggagcccgcagcaatgtcacatttactgtgaaccaaacatcccgcctcctgatgaggagaatgaggcgtccaactggaaaagtgaccctggaggctgacgtcatcctcccaattgggacacgcagtgttgagacagacaagggacccctggacaaagaggccatagaagaaagggttgagaggataaaatctgagtacatgacctcttggttttatgacaatgacaacccctacaggacctggcactactgtggctcctatgtcacaaaaacctcaggaagtgcggcgagcatggtaaatggtgttattaaaattctgacatatccatgggacaggatagaggaggtcacaagaatggcaatgactgacacaaccccttttggacagcaaagagtgtttaaagaaaaagttgacaccagagcaaaggatccaccagcgggaactaggaagatcatgaaagttgtcaacaggtggctgttccgccacctggccagagaaaagaaccccagactgtgcacaaaggaagaatttattgcaaaagtccgaagtcatgcagccattggagcttacctggaagaacaagaacagtggaagactgccaatgaggctgtccaagacccaaagttctgggaactggtggatgaagaaaggaagctgcaccaacaaggcaggtgtcggacttgtgtgtacaacatgatggggaaaagagagaagaagctgtcagagtttgggaaagcaaagggaagccgtgccatatggtatatgtggctgggagcgcggtatcttgagtttgaggccctgggattcctgaatgaggaccattgggcttccagggaaaactcaggaggaggagtggaaggcattggcttacaatacctaggatatgtgatcagagacctggctgcaatggatggtggtggattctacgcggatgacaccgctggatgggacacgcgcatcacagaggcagaccttgatgatgaacaggagatcttgaactacatgagcccacatcacaaaaaactggcacaagcagtgatggaaatgacatacaagaacaaagtggtgaaagtgttgagaccagccccaggagggaaagcctacatggatgtcataagtcgacgagaccagagaggatccgggcaggtagtgacttatgctctgaacaccatcaccaacttgaaagtccaattgatcagaatggcagaagcagagatggtgatacatcaccaacatgttcaagattgtgatgaatcagttctgaccaggctggaggcatggctcactgagcacggatgtgacagactgaagaggatggcggtgagtggagacgactgtgtggtccggcccatcgatgacaggttcggcctggccctgtcccatctcaacgccatgtccaaggttagaaaggacatatctgaatggcagccatcaaaagggtggaatgattgggagaatgtgcccttctgttcccaccacttccatgaactacagctgaaggatggcaggaggattgtggtgccttgccgagaacaggacgagctcattgggagaggaagggtgtctccaggaaacggctggatgatcaaggaaacagcttgcctcagcaaagcctatgccaacatgtggtcactgatgtattttcacaaaagggacatgaggctactgtcattggctgtttcctcagctgttcccacctcatgggttccacaaggacgcacaacatggtcgattcatgggaaaggggagtggatgaccacggaagacatgcttgaggtgtggaacagagtatggataaccaacaacccacacatgcaggacaagacaatggtgaaaaaatggagagatgtcccttatctaaccaagagacaagacaagctgtgcggatcactgattggaatgaccaatagggccacctgggcctcccacatccatttagtcatccatcgtatccgaacgctgattggacaggagaaatacactgactacctaacagtcatggacaggtattctgtggatgctgacctgcaactgggtgagcttatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 376 - RNA, 2554 nt, synthetic construct
  misc_feature 1..2554: note = mRNA product Design1 comprising derived and/or modified sequence from YFV 17D__NC_002031.1__C-prME (CDS wt)
  source 1..2554: mol_type = other RNA
gggagaaagcttaccatgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 377 - RNA, 3610 nt, synthetic construct
  misc_feature 1..3610: note = mRNA product Design1 comprising derived and/or modified sequence from YFV 17D__NC_002031.1__C-prME-NS1 (CDS wt)
  source 1..3610: mol_type = other RNA
gggagaaagcttaccatgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagttggcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccaggattcgggatggtctgcagtatggttggaagacttggggtaagaaccttgtgttctccccagggaggaagaatgggagcttcatcatagatggaaagtccaggaaagaatgcccgttttcaaaccgggtctggaactctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcatgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 378 - RNA, 2311 nt, synthetic construct
  misc_feature 1..2311: note = mRNA product Design1 comprising derived and/or modified sequence from YFV 17D__NC_002031.1__X-SS-prME-XX (CDS wt) R2387
  source 1..2311: mol_type = other RNA
gggagaaagcttaccatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaatccatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagtaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 379 - RNA, 1801 nt, synthetic construct
  misc_feature 1..1801: note = mRNA product Design1 comprising derived and/or modified sequence from YFV 17D__NC_002031.1__X-SS-E (CDS wt)
  source 1..1801: mol_type = other RNA
gggagaaagcttaccatgagaggattgtcctcaaggaaacgccgttcccatgatgttctgactgtgcaattcctaattttgggaatgctgttgatgacgggtggagtgaccttggtggctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 380 - RNA, 1831 nt, synthetic construct
  misc_feature 1..1831: note = mRNA product Design1 comprising derived and/or modified sequence from YFV 17D__NC_002031.1__X-SS-E-XX (CDS wt)
  source 1..1831: mol_type = other RNA
gggagaaagcttaccatgagaggattgtcctcaaggaaacgccgttcccatgatgttctgactgtgcaattcctaattttgggaatgctgttgatgacgggtggagtgaccttggtggctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 381 - RNA, 2248 nt, synthetic construct
  misc_feature 1..2248: note = mRNA product Design1 comprising derived and/or modified sequence from YFV 17D__NC_002031.1__SS-prME (CDS wt)
  source 1..2248: mol_type = other RNA
gggagaaagcttaccatggatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 382 - RNA, 3304 nt, synthetic construct
  misc_feature 1..3304: note = mRNA product Design1 comprising derived and/or modified sequence from YFV 17D__NC_002031.1__SS-prME-NS1 (CDS wt)
  source 1..3304: mol_type = other RNA
gggagaaagcttaccatggatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagttggcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccaggattcgggatggtctgcagtatggttggaagacttggggtaagaaccttgtgttctccccagggaggaagaatgggagcttcatcatagatggaaagtccaggaaagaatgcccgttttcaaaccgggtctggaactctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcatgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 383 - RNA, 10453 nt, synthetic construct
  misc_feature 1..10453: note = mRNA product Design1 comprising derived and/or modified sequence from YFV 17D__NC_002031.1__polyprotein (CDS opt1)
  source 1..10453: mol_type = other RNA
gggagaaagcttaccatgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctgtacaagctccacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtgaaggtcagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagagcgcccacgggtccccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtgcccctcgaggtgaagcgggaggcctgcccgggcaccagcgtcatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtaccccatggagatccggccccgcaagacgcacgagtcccacctggtccggagctgggtgaccgccggcgagatccacgccgtgcccttcgggctggtctccatgatgatcgccatggaggtggtgctccgcaagcggcagggccccaagcagatgctggtcggcggggtggtgctgctcggcgcgatgctggtcgggcaggtgaccctgctcgacctgctgaagctcaccgtggccgtcggcctgcacttccacgagatgaacaacgggggcgacgccatgtacatggccctgatcgccgcgttcagcatccgcccgggcctcctgatcgggttcggcctgcgcacgctctggagcccccgggagcgcctggtgctgaccctcggggccgccatggtggagatcgccctgggcggggtcatgggcggcctgtggaagtacctcaacgcggtgtccctgtgcatcctgaccatcaacgccgtggccagccggaaggcctccaacaccatcctccccctgatggccctgctcacccccgtcacgatggcggaggtgcgcctggccgccatgttcttctgcgccgtggtcatcatcggggtgctgcaccagaacttcaaggacaccagcatgcagaagaccatcccgctcgtggccctgaccctgacgtcctacctcggcctgacccagcccttcctggggctctgcgcgttcctggccacccggatcttcggccgccggagcatccccgtcaacgaggccctggccgccgcggggctcgtgggcgtgctggccggcctggccttccaggagatggagaacttcctcgggcccatcgccgtcggcgggctgctgatgatgctcgtgtccgtggccggccgcgtcgacggcctggagctgaagaagctcggggaggtgagctgggaggaggaggcggagatctccggcagctccgcccggtacgacgtggccctgagcgagcagggggagttcaagctgctctccgaggagaaggtcccgtgggaccaggtggtgatgaccagcctggccctggtcggcgcggccctccaccccttcgccctgctgctcgtgctggccgggtggctgttccacgtgcgcggcgcccggcgctccggcgacgtcctctgggacatccccacgcccaagatcatcgaggagtgcgagcacctggaggacgggatctacggcatcttccagagcaccttcctgggggcgtcccagcggggcgtgggggtcgcccagggcggcgtgttccacaccatgtggcacgtgacccgcggggccttcctcgtccggaacggcaagaagctgatcccgagctgggcctccgtgaaggaggacctggtggcctacgggggcagctggaagctcgaggggcgctgggacggcgaggaggaggtccagctgatcgcggccgtgcccggcaagaacgtggtcaacgtgcagacgaagcccagcctgttcaaggtgcggaacgggggcgagatcggggccgtcgccctggactacccgtccggcaccagcgggtcccccatcgtgaaccgcaacggcgaggtgatcggcctctacgggaacggcatcctggtcggggacaacagcttcgtgtccgccatcagccagaccgaggtgaaggaggagggcaaggaggagctgcaggagatccccaccatgctcaagaagggcatgacgaccgtcctggacttccaccccggggcgggcaagacccggcgcttcctgccgcagatcctcgccgagtgcgcccgccggcgcctgcggaccctggtgctcgcccccacgcgcgtggtcctgtccgagatgaaggaggcgttccacgggctggacgtgaagttccacacccaggccttcagcgcccacggctccgggcgggaggtgatcgacgccatgtgccacgccaccctcacctaccgcatgctggagcccacgcgggtcgtgaactgggaggtgatcatcatggacgaggcgcacttcctggaccccgccagcatcgccgcccgcggctgggccgcgcaccgggcccgcgccaacgagtccgccaccatcctcatgaccgccaccccgcccggcacgagcgacgagttcccccactccaacggggagatcgaggacgtccagaccgacatccccagcgagccgtggaacaccggccacgactggatcctggcggacaagcggcccaccgcctggttcctgccctccatccgcgccgccaacgtgatggcggccagcctccggaaggccgggaagtccgtggtcgtgctgaaccgcaagacgttcgagcgggagtaccccaccatcaagcagaagaagccggacttcatcctggccaccgacatcgccgagatgggcgcgaacctctgcgtggagcgcgtcctggactgccggaccgccttcaagcccgtgctggtggacgaggggcgcaaggtcgccatcaagggccccctccggatcagcgcctccagcgccgcgcagcgccggggccgcatcgggcgcaaccccaaccgggacggcgacagctactactactccgagccgacgagcgagaacaacgcccaccacgtgtgctggctggaggcctccatgctgctcgacaacatggaggtgcgcgggggcatggtcgccccgctgtacggggtggagggcaccaagacccccgtgagccccggcgagatgcggctgcgcgacgaccagcggaaggtcttccgcgagctcgtgcggaactgcgacctgccggtgtggctgtcctggcaggtcgccaaggcggggctcaagaccaacgaccgcaagtggtgcttcgagggccccgaggagcacgagatcctgaacgacagcggggagaccgtgaagtgccgggcccccggcggcgccaagaagcccctgcgcccgcggtggtgcgacgagcgcgtgtccagcgaccagtccgccctcagcgagttcatcaagttcgccgaggggcggcgcggcgcggccgaggtcctggtggtgctgtccgagctccccgacttcctggccaagaagggcggcgaggccatggacacgatcagcgtcttcctgcactccgaggaggggagccgggcgtaccgcaacgccctctccatgatgcccgaggccatgaccatcgtgatgctgttcatcctggccgggctcctgaccagcggcatggtcatcttcttcatgtccccgaaggggatcagccggatgtccatggccatgggcaccatggcggggtgcggctacctgatgttcctcgggggcgtgaagcccacgcacatcagctacgtgatgctgatcttcttcgtcctgatggtggtggtcatccccgagcccggccagcagcgcagcatccaggacaaccaggtggcctacctcatcatcgggatcctgaccctggtgtccgccgtcgccgccaacgagctcggcatgctggagaagaccaaggaggacctgttcgggaagaagaacctcatcccgagctccgcgagcccctggtcctggcccgacctggacctgaagcccggcgccgcctggaccgtgtacgtggggatcgtcacgatgctcagcccgatgctgcaccactggatcaaggtggagtacggcaacctgtccctcagcggcatcgcccagtccgccagcgtgctgtccttcatggacaaggggatccccttcatgaagatgaacatcagcgtcatcatgctgctcgtgtccggctggaacagcatcaccgtgatgcccctgctgtgcgggatcggctgcgcgatgctccactggtccctgatcctgcccgggatcaaggcccagcagagcaagctcgcccagcggcgcgtcttccacggcgtggccgagaacccggtggtcgacggcaaccccaccgtggacatcgaggaggcgcccgagatgcccgccctgtacgagaagaagctggccctctacctgctgctcgccctgtccctggccagcgtggcgatgtgccgcaccccgttctccctcgccgaggggatcgtcctggccagcgccgccctgggccccctcatcgaggggaacacgagcctgctgtggaacggccccatggcggtgtccatgaccggcgtgatgcgggggaaccactacgccttcgtcggcgtgatgtacaacctctggaagatgaagaccgggcgccggggcagcgccaacgggaagaccctgggcgaggtgtggaagcgcgagctgaacctcctggacaagcggcagttcgagctgtacaagcgcacggacatcgtcgaggtggaccgggacaccgcccgccggcacctcgccgagggcaaggtggacaccggggtcgcggtgtcccgcggcaccgccaagctgcggtggttccacgagcgcgggtacgtgaagctggagggccgggtcatcgacctcgggtgcggccgcggcgggtggtgctactacgccgccgcgcagaaggaggtgagcggcgtgaaggggttcacgctgggccgggacgggcacgagaagcccatgaacgtccagtccctgggctggaacatcatcaccttcaaggacaagaccgacatccaccgcctggagccggtgaagtgcgacaccctcctgtgcgacatcggcgagagctccagctccagcgtgacggagggggagcggaccgtccgcgtgctggacaccgtggagaagtggctcgcctgcggcgtcgacaacttctgcgtgaaggtgctggccccctacatgcccgacgtcctggagaagctcgagctgctgcagcggcgcttcgggggcaccgtgatccggaaccccctctcccgcaacagcacgcacgagatgtactacgtgtccggcgcccgcagcaacgtcaccttcaccgtgaaccagacctcccggctgctgatgcgccggatgcgccggccgacggggaaggtcaccctcgaggccgacgtgatcctgcccatcggcacccgcagcgtggagaccgacaaggggcccctggacaaggaggcgatcgaggagcgggtcgagcgcatcaagtccgagtacatgacgagctggttctacgacaacgacaacccctaccggacctggcactactgcggcagctacgtgaccaagacctccgggagcgccgcctccatggtgaacggcgtcatcaagatcctcacgtacccgtgggaccgcatcgaggaggtgacccggatggccatgaccgacaccacccccttcggccagcagcgcgtgttcaaggagaaggtcgacacgcgggccaaggacccgccggcggggacccgcaagatcatgaaggtggtgaaccggtggctgttccgccacctggcccgggagaagaacccccgcctctgcaccaaggaggagttcatcgccaaggtccggagccacgccgccatcggcgcgtacctggaggagcaggagcagtggaagaccgccaacgaggccgtgcaggaccccaagttctgggagctggtggacgaggagcgcaagctccaccagcaggggcgctgccggacgtgcgtctacaacatgatgggcaagcgcgagaagaagctgtccgagttcgggaaggccaagggcagccgggccatctggtacatgtggctgggcgcgcgctacctcgagttcgaggccctggggttcctgaacgaggaccactgggcctcccgggagaacagcggcgggggcgtggaggggatcggcctccagtacctgggctacgtgatccgcgacctggccgcgatggacgggggcgggttctacgccgacgacaccgccggctgggacacccggatcaccgaggccgacctcgacgacgagcaggagatcctgaactacatgtccccgcaccacaagaagctggcccaggcggtcatggagatgacgtacaagaacaaggtggtgaaggtcctccgcccggcccccgggggcaaggcctacatggacgtgatcagccggcgcgaccagcggggctccgggcaggtggtcacctacgccctgaacaccatcaccaacctgaaggtgcagctcatccgcatggccgaggcggagatggtgatccaccaccagcacgtccaggactgcgacgagagcgtgctgacgcggctggaggcctggctcaccgagcacggctgcgaccgcctgaagcggatggccgtgtccggggacgactgcgtcgtgcgccccatcgacgaccggttcggcctggccctcagccacctgaacgccatgtccaaggtgcgcaaggacatcagcgagtggcagccctccaagggctggaacgactgggagaacgtccccttctgcagccaccacttccacgagctgcagctcaaggacgggcggcgcatcgtggtgccctgccgggagcaggacgagctgatcggccgcgggcgcgtctcccccggcaacgggtggatgatcaaggagaccgcgtgcctgagcaaggcctacgccaacatgtggagcctcatgtacttccacaagcgggacatgcgcctgctgtccctcgccgtgagctccgcggtgcccaccagctgggtcccgcagggccggacgacctggtccatccacggcaagggggagtggatgaccaccgaggacatgctggaggtgtggaaccgcgtgtggatcacgaacaacccccacatgcaggacaagaccatggtcaagaagtggcgggacgtgccctacctgaccaagcgccaggacaagctctgcggcagcctgatcgggatgaccaaccgggccacgtgggcctcccacatccacctggtgatccaccgcatccggaccctcatcggccaggagaagtacaccgactacctgaccgtcatggaccgctacagcgtggacgccgacctgcagctcggggagctgatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 384 - RNA, 2554 nt, synthetic construct
  misc_feature 1..2554: note = mRNA product Design1 comprising derived and/or modified sequence from YFV 17D__NC_002031.1__C-prME (CDS opt1) R2609/R2610
  source 1..2554: mol_type = other RNA
gggagaaagcttaccatgagcggccggaaggcccaggggaagaccctgggcgtgaacatggtccgccggggcgtgcgctccctcagcaacaagatcaagcagaagaccaagcagatcgggaaccggcccgggccgtcccgcggcgtgcagggcttcatcttcttcttcctgttcaacatcctgacggggaagaagatcaccgcccacctcaagcggctgtggaagatgctggacccccgccagggcctcgcggtcctgcggaaggtgaagcgcgtggtcgccagcctgatgcgggggctctccagccgcaagcggcgcagccacgacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 385 - RNA, 3610 nt, synthetic construct
  misc_feature 1..3610: note = mRNA product Design1 comprising derived and/or modified sequence from YFV 17D__NC_002031.1__C-prME-NS1 (CDS opt1) R2585/R2586
  source 1..3610: mol_type = other RNA
gggagaaagcttaccatgagcggccggaaggcccaggggaagaccctgggcgtgaacatggtccgccggggcgtgcgctccctcagcaacaagatcaagcagaagaccaagcagatcgggaaccggcccgggccgtcccgcggcgtgcagggcttcatcttcttcttcctgttcaacatcctgacggggaagaagatcaccgcccacctcaagcggctgtggaagatgctggacccccgccagggcctcgcggtcctgcggaaggtgaagcgcgtggtcgccagcctgatgcgggggctctccagccgcaagcggcgcagccacgacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgccgaccagggctgcgccatcaacttcgggaagcgggagctgaagtgcggcgacgggatcttcatcttccgcgacagcgacgactggctcaacaagtactcctactaccccgaggacccggtgaagctggccagcatcgtcaaggcgtccttcgaggagggcaagtgcgggctgaacagcgtggactccctcgagcacgagatgtggcggagccgcgccgacgagatcaacgccatcttcgaggagaacgaggtggacatctccgtcgtggtgcaggaccccaagaacgtctaccagcggggcacccaccccttcagccgcatccgggacggcctgcagtacgggtggaagacctggggcaagaacctggtgttctcccccgggcgcaagaacggcagcttcatcatcgacgggaagtcccggaaggagtgcccgttcagcaaccgcgtgtggaactccttccagatcgaggagttcggcacgggcgtcttcaccacccgggtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccgcagcatcgggggcccggtcagctcccacaaccacatccccgggtacaaggtgcagaccaacggcccctggatgcaggtgcccctggaggtcaagcgggaggcctgcccgggcaccagcgtgatcatcgacgggaactgcgacggccgcgggaagtccacgcggagcaccaccgactccggcaaggtgatccccgagtggtgctgccgcagctgcaccatgccgcccgtctccttccacgggagcgacggctgctggtacccgatggagatccggccccgcaagacgcacgagtcccacctggtgcggagctgggtgaccgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 386 - RNA, 2311 nt, synthetic construct
  misc_feature 1..2311: note = mRNA product Design1 comprising derived and/or modified sequence from YFV 17D__NC_002031.1__X-SS-prME-XX (CDS opt1) R2388
  source 1..2311: mol_type = other RNA
gggagaaagcttaccatgcggggcctgagctcccgcaagcggcgcagccacgacgtgctcaccgtccagttcctgatcctggggatgctcctgatgaccggcggggtgacgctggtgcggaagaaccgctggctcctgctgaacgtcacctccgaggacctcggcaagaccttcagcgtggggaccggcaactgcacgaccaacatcctggaggccaagtactggtgccccgactccatggagtacaactgcccgaacctgagcccccgggaggagcccgacgacatcgactgctggtgctacggcgtggagaacgtccgcgtggcctacgggaagtgcgactccgcgggccggagccgccggtcccgccgggccatcgacctccccacccacgagaaccacgggctgaagacccgccaggagaagtggatgacgggccggatgggggagcgccagctgcagaagatcgagcggtggttcgtgcgcaacccgttcttcgccgtcaccgccctcaccatcgcctacctggtgggcagcaacatgacccagcgggtggtcatcgcgctgctcgtgctggccgtgggccccgcctactccgcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 387 - RNA, 1801 nt, synthetic construct
  misc_feature 1..1801: note = mRNA product Design1 comprising derived and/or modified sequence from YFV 17D__NC_002031.1__X-SS-E (CDS opt1) R2554
  source 1..1801: mol_type = other RNA
gggagaaagcttaccatgcggggcctgagctcccgcaagcggcgcagccacgacgtgctcaccgtccagttcctgatcctggggatgctcctgatgaccggcggggtgacgctggtggcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 388 - RNA, 1831 nt, synthetic construct
  misc_feature 1..1831: note = mRNA product Design1 comprising derived and/or modified sequence from YFV 17D__NC_002031.1__X-SS-E-XX (CDS opt1)
  source 1..1831: mol_type = other RNA
gggagaaagcttaccatgcggggcctgagctcccgcaagcggcgcagccacgacgtgctcaccgtccagttcctgatcctggggatgctcctgatgaccggcggggtgacgctggtggcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 389 - RNA, 2335 nt, synthetic construct
  misc_feature 1..2335: note = mRNA product Design1 comprising derived and/or modified sequence from YFV 17D__NC_002031.1__X-SS-prME-TMcFlag-10aa (CDS opt1) R2548
  source 1..2335: mol_type = other RNA
gggagaaagcttaccatgcggggcctgagctcccgcaagcggcgcagccacgacgtgctcaccgtccagttcctgatcctggggatgctcctgatgaccggcggggtgacgctggtgcggaagaaccgctggctcctgctgaacgtcacctccgaggacctcggcaagaccttcagcgtggggaccggcaactgcacgaccaacatcctggaggccaagtactggtgccccgactccatggagtacaactgcccgaacctgagcccccgggaggagcccgacgacatcgactgctggtgctacggcgtggagaacgtccgcgtggcctacgggaagtgcgactccgcgggccggagccgccggtcccgccgggccatcgacctccccacccacgagaaccacgggctgaagacccgccaggagaagtggatgacgggccggatgggggagcgccagctgcagaagatcgagcggtggttcgtgcgcaacccgttcttcgccgtcaccgccctcaccatcgcctacctggtgggcagcaacatgacccagcgggtggtcatcgcgctgctcgtgctggccgtgggccccgcctactccgcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcgactacaaggacgacgacgacaagaacatgaccatgtccatgagcatgatcctcgtgggggtgatcatgatgttcctgagcctgggcgtcggggcggaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 390 - RNA, 2335 nt, synthetic construct
  misc_feature 1..2335: note = mRNA product Design1 comprising derived and/or modified sequence from YFV 17D__NC_002031.1__X-SS-prME-intFlag-10aa (CDS opt1) R2549
  source 1..2335: mol_type = other RNA
gggagaaagcttaccatgcggggcctgagctcccgcaagcggcgcagccacgacgtgctcaccgtccagttcctgatcctggggatgctcctgatgaccggcggggtgacgctggtgcggaagaaccgctggctcctgctgaacgtcacctccgaggacctcggcaagaccttcagcgtggggaccggcaactgcacgaccaacatcctggaggccaagtactggtgccccgactccatggagtacaactgcccgaacctgagcccccgggaggagcccgacgacatcgactgctggtgctacggcgtggagaacgtccgcgtggcctacgggaagtgcgactccgcgggccggagccgccggtcccgccgggccatcgacctccccacccacgagaaccacgggctgaagacccgccaggagaagtggatgacgggccggatgggggagcgccagctgcagaagatcgagcggtggttcgtgcgcaacccgttcttcgccgtcaccgccctcaccatcgcctacctggtgggcagcaacatgacccagcgggtggtcatcgcgctgctcgtgctggccgtgggccccgcctactccgcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggaggactacaaggacgacgacgacaagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 391 - RNA, 2248 nt, synthetic construct
  misc_feature 1..2248: note = mRNA product Design1 comprising derived and/or modified sequence from YFV 17D__NC_002031.1__SS-prME (CDS opt1) R2605/R2606
  source 1..2248: mol_type = other RNA
gggagaaagcttaccatggacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 392 - RNA, 3304 nt, synthetic construct
  misc_feature 1..3304: note = mRNA product Design1 comprising derived and/or modified sequence from YFV 17D__NC_002031.1__SS-prME-NS1 (CDS opt1) R2613/R2614
  source 1..3304: mol_type = other RNA
gggagaaagcttaccatggacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgccgaccagggctgcgccatcaacttcgggaagcgggagctgaagtgcggcgacgggatcttcatcttccgcgacagcgacgactggctcaacaagtactcctactaccccgaggacccggtgaagctggccagcatcgtcaaggcgtccttcgaggagggcaagtgcgggctgaacagcgtggactccctcgagcacgagatgtggcggagccgcgccgacgagatcaacgccatcttcgaggagaacgaggtggacatctccgtcgtggtgcaggaccccaagaacgtctaccagcggggcacccaccccttcagccgcatccgggacggcctgcagtacgggtggaagacctggggcaagaacctggtgttctcccccgggcgcaagaacggcagcttcatcatcgacgggaagtcccggaaggagtgcccgttcagcaaccgcgtgtggaactccttccagatcgaggagttcggcacgggcgtcttcaccacccgggtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccgcagcatcgggggcccggtcagctcccacaaccacatccccgggtacaaggtgcagaccaacggcccctggatgcaggtgcccctggaggtcaagcgggaggcctgcccgggcaccagcgtgatcatcgacgggaactgcgacggccgcgggaagtccacgcggagcaccaccgactccggcaaggtgatccccgagtggtgctgccgcagctgcaccatgccgcccgtctccttccacgggagcgacggctgctggtacccgatggagatccggccccgcaagacgcacgagtcccacctggtgcggagctgggtgaccgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 393 - RNA, 10453 nt, synthetic construct
  misc_feature 1..10453: note = mRNA product Design1 comprising derived and/or modified sequence from YFV 17D__NC_002031.1__polyprotein (CDS opt1)
  source 1..10453: mol_type = other RNA
gggagaaagcttaccatgagcgggcgcaaggcccaggggaagaccctgggggtgaacatggtgcggcgcggggtgcggtccctcagcaacaagatcaagcagaagaccaagcagatcggcaaccgccccgggccctcccggggcgtgcagggcttcatcttcttcttcctgttcaacatcctgacggggaagaagatcaccgcccacctcaagcgcctgtggaagatgctggacccccggcagggcctcgccgtgctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaacccgaccgacacgggccacggcaccgtcgtgatgcaggtcaaggtcagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagtccgcccacgggtccccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtccccctcgaggtgaagcgggaggcctgcccgggcaccagcgtcatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtacccgatggagatccggccccgcaagacgcacgagtcccacctggtccggagctgggtgaccgccggcgagatccacgccgtgcccttcgggctggtctccatgatgatcgccatggaggtggtgctccgcaagcggcagggccccaagcagatgctggtcggcggggtggtgctgctcggcgcgatgctggtcggccaggtgaccctgctcgacctgctgaagctcaccgtggccgtcggcctgcacttccacgagatgaacaacgggggcgacgccatgtacatggccctgatcgccgcgttcagcatccgcccgggcctcctgatcgggttcggcctgcgcacgctctggagcccccgggagcgcctggtgctgaccctcggggccgccatggtggagatcgccctgggcggggtcatgggcggcctgtggaagtacctcaacgcggtgtccctgtgcatcctgaccatcaacgccgtggccagccggaaggcctccaacaccatcctccccctgatggccctgctcacccccgtcacgatggcggaggtgcgcctggccgccatgttcttctgcgccgtggtcatcatcggggtgctgcaccagaacttcaaggacaccagcatgcagaagaccatcccgctcgtggccctgaccctgacgtcctacctcggcctgacccagcccttcctggggctctgcgcgttcctggccacccggatcttcggccgccggagcatccccgtcaacgaggccctggccgccgcggggctcgtgggcgtgctggccggcctggccttccaggagatggagaacttcctcgggcccatcgccgtcggcgggctgctgatgatgctcgtgtccgtggccggccgcgtcgacggcctggagctgaagaagctcggggaggtgagctgggaggaggaggcggagatctccggcagctccgcccggtacgacgtggccctgagcgagcagggggagttcaagctgctctccgaggagaaggtcccgtgggaccaggtggtgatgaccagcctggccctggtcggcgcggccctccaccccttcgccctgctgctcgtgctggccgggtggctgttccacgtgcgcggcgcccggcgctccggcgacgtcctctgggacatccccacgcccaagatcatcgaggagtgcgagcacctggaggacgggatctacggcatcttccagagcaccttcctgggggcgtcccagcggggcgtgggggtcgcccagggcggcgtgttccacaccatgtggcacgtgacccgcggggccttcctcgtccggaacggcaagaagctgatcccgagctgggcctccgtgaaggaggacctggtggcctacgggggcagctggaagctcgaggggcgctgggacggcgaggaggaggtccagctgatcgcggccgtgcccggcaagaacgtggtcaacgtgcagacgaagcccagcctgttcaaggtgcggaacgggggcgagatcggggccgtcgccctggactacccgtccggcaccagcgggtcccccatcgtgaaccgcaacggcgaggtgatcggcctctacgggaacggcatcctggtcggggacaacagcttcgtgtccgccatcagccagaccgaggtgaaggaggagggcaaggaggagctgcaggagatccccaccatgctcaagaagggcatgacgaccgtcctggacttccaccccggggcgggcaagacccggcgcttcctgccgcagatcctcgccgagtgcgcccgccggcgcctgcggaccctggtgctcgcccccacgcgcgtggtcctgtccgagatgaaggaggcgttccacgggctggacgtgaagttccacacccaggccttcagcgcccacggctccgggcgggaggtgatcgacgccatgtgccacgccaccctcacctaccgcatgctggagcccacgcgggtcgtgaactgggaggtgatcatcatggacgaggcgcacttcctggaccccgccagcatcgccgcccgcggctgggccgcgcaccgggcccgcgccaacgagtccgccaccatcctcatgaccgccaccccgcccggcacgagcgacgagttcccccactccaacggggagatcgaggacgtccagaccgacatccccagcgagccgtggaacaccggccacgactggatcctggcggacaagcggcccaccgcctggttcctgccctccatccgcgccgccaacgtgatggcggccagcctccggaaggccgggaagtccgtggtcgtgctgaaccgcaagacgttcgagcgggagtaccccaccatcaagcagaagaagccggacttcatcctggccaccgacatcgccgagatgggcgcgaacctctgcgtggagcgcgtcctggactgccggaccgccttcaagcccgtgctggtggacgaggggcgcaaggtcgccatcaagggccccctccggatcagcgcctccagcgccgcgcagcgccggggccgcatcgggcgcaaccccaaccgggacggcgacagctactactactccgagccgacgagcgagaacaacgcccaccacgtgtgctggctggaggcctccatgctgctcgacaacatggaggtgcgcgggggcatggtcgcgcccctgtacggggtggagggcaccaagacccccgtgagccccggcgagatgcggctgcgcgacgaccagcggaaggtcttccgcgagctcgtgcggaactgcgacctgccggtgtggctgtcctggcaggtcgccaaggcggggctcaagaccaacgaccgcaagtggtgcttcgagggccccgaggagcacgagatcctgaacgacagcggggagaccgtgaagtgccgggcccccggcggcgccaagaagcccctgcgcccgcggtggtgcgacgagcgcgtgtccagcgaccagtccgccctcagcgagttcatcaagttcgccgaggggcggcgcggcgcggccgaggtcctggtggtgctgtccgagctccccgacttcctggccaagaagggcggggaggccatggacacgatcagcgtcttcctgcactccgaggaggggagccgggcgtaccgcaacgccctctccatgatgcccgaggccatgaccatcgtgatgctgttcatcctggccggcctcctgaccagcggcatggtcatcttcttcatgtccccgaaggggatcagccggatgtccatggccatgggcaccatggcggggtgcggctacctgatgttcctcgggggcgtgaagcccacgcacatcagctacgtgatgctgatcttcttcgtcctgatggtggtggtcatccccgagcccggccagcagcgcagcatccaggacaaccaggtggcctacctcatcatcgggatcctgaccctggtgtccgccgtcgccgccaacgagctcggcatgctggagaagaccaaggaggacctgttcgggaagaagaacctcatcccgagctccgcgagcccctggtcctggcccgacctggacctgaagcccggcgccgcctggaccgtgtacgtggggatcgtcacgatgctcagcccgatgctgcaccactggatcaaggtggagtacggcaacctgtccctcagcggcatcgcccagtccgccagcgtgctgtccttcatggacaaggggatccccttcatgaagatgaacatcagcgtcatcatgctgctcgtgtccggctggaacagcatcaccgtgatgcccctgctgtgcgggatcggctgcgcgatgctccactggtccctgatcctgcccgggatcaaggcccagcagagcaagctcgcccagcggcgcgtcttccacggcgtggccgagaacccggtggtcgacggcaaccccaccgtggacatcgaggaggcgcccgagatgcccgccctgtacgagaagaagctggccctctacctgctgctcgccctgtccctggccagcgtggcgatgtgccgcaccccgttctccctcgccgaggggatcgtcctggccagcgccgccctgggccccctcatcgaggggaacacgagcctgctgtggaacggccccatggcggtgtccatgaccggcgtgatgcgggggaaccactacgccttcgtcggcgtgatgtacaacctctggaagatgaagaccgggcgccggggcagcgccaacgggaagaccctgggcgaggtgtggaagcgcgagctgaacctcctggacaagcggcagttcgagctgtacaagcgcacggacatcgtcgaggtggaccgggacaccgcccgccggcacctcgccgagggcaaggtggacaccggggtcgcggtgtcccgcggcaccgccaagctgcggtggttccacgagcgcgggtacgtgaagctggagggccgggtcatcgacctcgggtgcggccgcggcgggtggtgctactacgccgccgcgcagaaggaggtgagcggcgtgaaggggttcacgctgggccgggacgggcacgagaagcccatgaacgtccagtccctgggctggaacatcatcaccttcaaggacaagaccgacatccaccgcctcgagccggtgaagtgcgacaccctgctgtgcgacatcggcgagagctccagctccagcgtgacggagggggagcggaccgtccgcgtgctggacaccgtggagaagtggctcgcctgcggcgtcgacaacttctgcgtgaaggtgctggccccctacatgcccgacgtcctggagaagctcgagctgctgcagcggcgcttcgggggcaccgtgatccggaaccccctctcccgcaacagcacgcacgagatgtactacgtgtccggcgcccgcagcaacgtcaccttcaccgtgaaccagacctcccggctgctgatgcgccggatgcgccggccgacggggaaggtcaccctcgaggccgacgtgatcctgcccatcggcacccgcagcgtggagaccgacaaggggcccctggacaaggaggcgatcgaggagcgggtcgagcgcatcaagtccgagtacatgacgagctggttctacgacaacgacaacccctaccggacctggcactactgcggcagctacgtgaccaagacctccgggagcgccgcctccatggtgaacggcgtcatcaagatcctcacgtacccgtgggaccgcatcgaggaggtgacccggatggccatgaccgacaccacccccttcggccagcagcgcgtgttcaaggagaaggtcgacacgcgggccaaggacccgcccgcggggacccgcaagatcatgaaggtggtgaaccggtggctgttccgccacctggcccgggagaagaacccccgcctctgcaccaaggaggagttcatcgccaaggtccggagccacgccgccatcggcgcgtacctggaggagcaggagcagtggaagaccgccaacgaggccgtgcaggaccccaagttctgggagctggtggacgaggagcgcaagctccaccagcaggggcgctgccggacgtgcgtctacaacatgatgggcaagcgcgagaagaagctgtccgagttcgggaaggccaagggcagccgggccatctggtacatgtggctgggcgcgcgctacctcgagttcgaggccctggggttcctgaacgaggaccactgggcctcccgggagaacagcggcgggggcgtggaggggatcggcctccagtacctgggctacgtgatccgcgacctggccgcgatggacgggggcgggttctacgccgacgacaccgccggctgggacacccggatcaccgaggccgacctcgacgacgagcaggagatcctgaactacatgagcccccaccacaagaagctggcccaggcggtcatggagatgacgtacaagaacaaggtggtgaaggtcctccgccccgcccccgggggcaaggcctacatggacgtgatcagccggcgcgaccagcggggctccggccaggtggtcacctacgccctgaacaccatcaccaacctgaaggtgcagctcatccgcatggccgaggcggagatggtgatccaccaccagcacgtccaggactgcgacgagagcgtgctgacgcggctggaggcctggctcaccgagcacggctgcgaccgcctgaagcggatggccgtgtccggggacgactgcgtcgtgcgccccatcgacgaccggttcggcctggccctcagccacctgaacgccatgtccaaggtgcgcaaggacatcagcgagtggcagccctccaagggctggaacgactgggagaacgtcccgttctgcagccaccacttccacgagctgcagctcaaggacgggcggcgcatcgtggtgccctgccgggagcaggacgagctgatcggccgcgggcgcgtctcccccggcaacgggtggatgatcaaggagaccgcgtgcctgagcaaggcctacgccaacatgtggagcctcatgtacttccacaagcgggacatgcgcctgctgtccctcgccgtgagctccgcggtgcccaccagctgggtcccgcagggccggacgacctggtccatccacggcaagggggagtggatgaccaccgaggacatgctggaggtgtggaaccgcgtgtggatcacgaacaacccccacatgcaggacaagaccatggtcaagaagtggcgggacgtgccctacctgaccaagcgccaggacaagctctgcggcagcctgatcgggatgaccaaccgggccacgtgggcctcccacatccacctggtgatccaccgcatccggaccctcatcggccaggagaagtacaccgactacctgaccgtcatggaccgctacagcgtggacgccgacctgcagctcggggagctgatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 394 - RNA, 2554 nt, synthetic construct
  misc_feature 1..2554: note = mRNA product Design1 comprising derived and/or modified sequence from YFV 17D__NC_002031.1__C-prME (CDS opt1)
  source 1..2554: mol_type = other RNA
gggagaaagcttaccatgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtcaaggtgagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 395 - RNA, 3610 nt, synthetic construct
  misc_feature 1..3610: note = mRNA product Design1 comprising derived and/or modified sequence from YFV 17D__NC_002031.1__C-prME-NS1 (CDS opt1)
  source 1..3610: mol_type = other RNA
gggagaaagcttaccatgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtcaaggtgagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagtccgcccacgggagcccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtccccctcgaggtgaagcgggaggcctgcccgggcaccagcgtgatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtaccccatggagatccggccccgcaagacgcacgagtcccacctggtccggagctgggtgaccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 396 - RNA, 2311 nt, synthetic construct
  misc_feature 1..2311: note = mRNA product Design1 comprising derived and/or modified sequence from YFV 17D__NC_002031.1__X-SS-prME-XX (CDS opt1)
  source 1..2311: mol_type = other RNA
gggagaaagcttaccatgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccgccagtgggcccaggacctgaccctgccctggcagtccggcagcggcggggtctggcgggagatgcaccacctcgtggagttcgagcccccgcacgccgccacgatccgcgtgctggcgctgggcaaccaggaggggtccctcaagaccgccctgaccggcgccatgcgggtcaccaaggacacgaacgacaacaacctgtacaagctccacgggggccacgtgagctgccgcgtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccggatccccgtgatcgtcgccgacgacctgaccgccgccatcaacaagggcatcctggtgaccgtgaacccgatcgccagcacgaacgacgacgaggtcctcatcgaggtgaacccgcccttcggcgactcctacatcatcgtggggcgcggcgacagccggctgacctaccagtggcacaaggaggggtccagcatcggcaagctgttcacccagaccatgaagggggtcgagcgcctcgcggtgatgggcgacacggcctgggacttctccagcgccggcgggttcttcacctccgtgggcaaggggatccacaccgtcttcggcagcgccttccaggggctgttcggcggcctgaactggatcaccaaggtgatcatgggggccgtgctgatctgggtcggcatcaacacgcggaacatgaccatgtccatgagcatgatcctcgtgggggtgatcatgatgttcctgagcctgggcgtcggggcggaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 397 - RNA, 1801 nt, synthetic construct
  misc_feature 1..1801: note = mRNA product Design1 comprising derived and/or modified sequence from YFV 17D__NC_002031.1__X-SS-E (CDS opt1)
  source 1..1801: mol_type = other RNA
gggagaaagcttaccatgcgcggcctgagctcccggaagcgccggagccacgacgtgctcaccgtccagttcctgatcctggggatgctcctgatgaccggcggggtgacgctggtggcccactgcatcggcatcaccgaccgcgacttcatcgagggggtccacggcggcacctgggtgtccgccaccctcgagcaggacaagtgcgtgacggtcatggcgcccgacaagcccagcctggacatctccctggagaccgtggccatcgaccggcccgccgaggtgcgcaaggtctgctacaacgccgtgctcacccacgtgaagatcaacgacaagtgccccagcaccggggaggcccacctggcggaggagaacgagggcgacaacgcctgcaagcggacgtactccgaccgcgggtggggcaacgggtgcggcctgttcggcaaggggagcatcgtcgcctgcgccaagttcacgtgcgcgaagtccatgagcctcttcgaggtggaccagaccaagatccagtacgtgatccgggcccagctgcacgtcggcgccaagcaggagaactggaacaccgacatcaagaccctgaagttcgacgccctctccgggagccaggaggtggagttcatcggctacggcaaggccaccctggagtgccaggtgcagaccgcggtcgacttcgggaactcctacatcgccgagatggagaccgagagctggatcgtggaccgccagtgggcccaggacctgacgctcccctggcagtccggcagcgggggcgtgtggcgggagatgcaccacctggtcgagttcgagccgccccacgccgccaccatccgcgtgctggcgctcgggaaccaggagggctccctgaagaccgccctgaccggcgccatgcgggtgacgaaggacaccaacgacaacaacctctacaagctgcacgggggccacgtcagctgccgcgtgaagctgtccgccctcaccctgaaggggaccagctacaagatctgcacggacaagatgttcttcgtcaagaaccccaccgacaccggccacgggaccgtggtgatgcaggtcaaggtgagcaagggcgccccctgccggatcccggtgatcgtcgcggacgacctgacggccgccatcaacaagggcatcctcgtgaccgtgaaccccatcgcctccaccaacgacgacgaggtcctgatcgaggtgaacccgcccttcggggacagctacatcatcgtgggccgcggggactcccggctgacctaccagtggcacaaggagggcagctccatcgggaagctgttcacgcagaccatgaagggcgtcgagcgcctcgccgtgatgggcgacaccgcgtgggacttcagctccgccgggggcttcttcaccagcgtggggaagggcatccacacggtcttcggctccgccttccaggggctgttcggcgggctcaactggatcaccaaggtgatcatgggcgccgtgctgatctgggtcgggatcaacacccggaacatgaccatgagcatgtccatgatcctggtgggcgtgatcatgatgttcctcagcctgggcgtcggggcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 398 - RNA, 1831 nt, synthetic construct
  misc_feature 1..1831: note = mRNA product Design1 comprising derived and/or modified sequence from YFV 17D__NC_002031.1__X-SS-E-XX (CDS opt1)
  source 1..1831: mol_type = other RNA
gggagaaagcttaccatgcgcggcctgagctcccggaagcgccggagccacgacgtgctcaccgtccagttcctgatcctggggatgctcctgatgaccggcggggtgacgctggtggcccactgcatcggcatcaccgaccgcgacttcatcgagggggtccacggcggcacctgggtgtccgccaccctcgagcaggacaagtgcgtgacggtcatggcgcccgacaagcccagcctggacatctccctggagaccgtggccatcgaccggcccgccgaggtgcgcaaggtctgctacaacgccgtgctcacccacgtgaagatcaacgacaagtgccccagcaccggggaggcccacctggcggaggagaacgagggcgacaacgcctgcaagcggacgtactccgaccgcgggtggggcaacgggtgcggcctgttcggcaaggggagcatcgtcgcctgcgccaagttcacgtgcgcgaagtccatgagcctcttcgaggtggaccagaccaagatccagtacgtgatccgggcccagctgcacgtcggcgccaagcaggagaactggaacaccgacatcaagaccctgaagttcgacgccctctccgggagccaggaggtggagttcatcggctacggcaaggccaccctggagtgccaggtgcagaccgcggtcgacttcgggaactcctacatcgccgagatggagaccgagagctggatcgtggaccgccagtgggcccaggacctgacgctcccctggcagtccggcagcgggggcgtgtggcgggagatgcaccacctggtcgagttcgagccgccccacgccgccaccatccgcgtgctggcgctcgggaaccaggagggctccctgaagaccgccctgaccggcgccatgcgggtgacgaaggacaccaacgacaacaacctctacaagctgcacgggggccacgtcagctgccgcgtgaagctgtccgccctcaccctgaaggggaccagctacaagatctgcacggacaagatgttcttcgtcaagaaccccaccgacaccggccacgggaccgtggtgatgcaggtcaaggtgagcaagggcgccccctgccggatcccggtgatcgtcgcggacgacctgacggccgccatcaacaagggcatcctcgtgaccgtgaaccccatcgcctccaccaacgacgacgaggtcctgatcgaggtgaacccgcccttcggggacagctacatcatcgtgggccgcggggactcccggctgacctaccagtggcacaaggagggcagctccatcgggaagctgttcacgcagaccatgaagggcgtcgagcgcctcgccgtgatgggcgacaccgcgtgggacttcagctccgccgggggcttcttcaccagcgtggggaagggcatccacacggtcttcggctccgccttccaggggctgttcggcgggctcaactggatcaccaaggtgatcatgggcgccgtgctgatctgggtcgggatcaacacccggaacatgaccatgagcatgtccatgatcctggtgggcgtgatcatgatgttcctcagcctgggcgtcggggcggaccagggctgcgccatcaacttcgggaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 399 - RNA, 2248 nt, synthetic construct
  misc_feature 1..2248: note = mRNA product Design1 comprising derived and/or modified sequence from YFV 17D__NC_002031.1__SS-prME (CDS opt1)
  source 1..2248: mol_type = other RNA
gggagaaagcttaccatggacgtgctgaccgtccagttcctcatcctgggcatgctgctcatgaccgggggcgtgacgctggtgcgcaagaaccggtggctgctcctgaacgtcaccagcgaggacctggggaagaccttctccgtgggcaccgggaactgcacgaccaacatcctcgaggccaagtactggtgccccgacagcatggagtacaactgccccaacctgagcccccgcgaggagcccgacgacatcgactgctggtgctacggcgtggagaacgtccgggtggcctacggcaagtgcgactccgcggggcgctcccggcgcagccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggtccaacatgacccagcgcgtggtcatcgcgctgctggtgctcgccgtgggccccgcctacagcgcccactgcatcggcatcacggaccgggacttcatcgagggggtccacggcgggacctgggtgtccgcgaccctggagcaggacaagtgcgtgaccgtcatggcccccgacaagcccagcctggacatctccctcgagacggtggccatcgaccgcccggccgaggtgcggaaggtctgctacaacgccgtgctgacccacgtgaagatcaacgacaagtgccccagcaccggcgaggcgcacctggccgaggagaacgagggcgacaacgcctgcaagcgcacctactccgaccgggggtggggcaacgggtgcggcctcttcgggaagggcagcatcgtcgcctgcgccaagttcacgtgcgcgaagtccatgagcctgttcgaggtggaccagaccaagatccagtacgtcatccgcgcccagctgcacgtgggcgccaagcaggagaactggaacaccgacatcaagaccctcaagttcgacgccctgtccgggagccaggaggtggagttcatcggctacgggaaggccacgctggagtgccaggtccagaccgcggtggacttcggcaactcctacatcgccgagatggagaccgagagctggatcgtggaccggcagtgggcccaggacctcaccctgccctggcagagcgggtccggcggcgtctggcgcgagatgcaccacctggtggagttcgagcccccgcacgccgccacgatccgcgtgctcgcgctggggaaccaggagggcagcctgaagaccgccctcaccggggccatgcgggtcaccaaggacacgaacgacaacaacctgtacaagctgcacggcgggcacgtgtcctgccgcgtgaagctcagcgccctgaccctgaagggcacctcctacaagatctgcaccgacaagatgttcttcgtcaagaaccccacggacaccggccacgggaccgtggtgatgcaggtcaaggtgagcaagggcgcgccctgccggatccccgtgatcgtcgccgacgacctcaccgccgccatcaacaaggggatcctggtgaccgtgaacccgatcgcctccacgaacgacgacgaggtcctgatcgaggtgaacccgcccttcggcgacagctacatcatcgtgggccgcggggactcccggctcacctaccagtggcacaaggagggcagctccatcgggaagctgttcacccagaccatgaagggcgtcgagcgcctggcggtgatgggggacacggcctgggacttcagctccgccggcggcttcttcaccagcgtggggaagggcatccacaccgtcttcgggtccgccttccagggcctcttcgggggcctgaactggatcaccaaggtgatcatgggcgccgtgctgatctgggtcgggatcaacacgcggaacatgaccatgagcatgtccatgatcctggtgggcgtgatcatgatgttcctcagcctgggggtcggcgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 400 - RNA, 3304 nt, synthetic construct
  misc_feature 1..3304: note = mRNA product Design1 comprising derived and/or modified sequence from YFV 17D__NC_002031.1__SS-prME-NS1 (CDS opt1)
  source 1..3304: mol_type = other RNA
gggagaaagcttaccatggacgtgctgaccgtccagttcctcatcctgggcatgctgctcatgaccgggggcgtgacgctggtgcgcaagaaccggtggctgctcctgaacgtcaccagcgaggacctggggaagaccttctccgtgggcaccgggaactgcacgaccaacatcctcgaggccaagtactggtgccccgacagcatggagtacaactgcccgaacctgagcccccgcgaggagcccgacgacatcgactgctggtgctacggcgtggagaacgtccgggtggcctacggcaagtgcgactccgcggggcgctcccggcgcagccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggtccaacatgacccagcgcgtggtcatcgcgctgctggtgctcgccgtgggccccgcctacagcgcccactgcatcggcatcacggaccgggacttcatcgagggggtccacggcgggacctgggtgtccgcgaccctggagcaggacaagtgcgtgaccgtcatggcccccgacaagcccagcctggacatctccctcgagacggtggccatcgaccgcccggccgaggtgcggaaggtctgctacaacgccgtgctgacccacgtgaagatcaacgacaagtgccccagcaccggcgaggcgcacctggccgaggagaacgagggcgacaacgcctgcaagcgcacctactccgaccgggggtggggcaacgggtgcggcctcttcgggaagggcagcatcgtcgcctgcgccaagttcacgtgcgcgaagtccatgagcctgttcgaggtggaccagaccaagatccagtacgtcatccgcgcccagctgcacgtgggcgccaagcaggagaactggaacaccgacatcaagaccctcaagttcgacgccctgtccgggagccaggaggtggagttcatcggctacgggaaggccacgctggagtgccaggtccagaccgcggtggacttcggcaactcctacatcgccgagatggagaccgagagctggatcgtggaccggcagtgggcccaggacctcaccctgccctggcagagcgggtccggcggcgtctggcgcgagatgcaccacctggtggagttcgagcccccgcacgccgccacgatccgcgtgctcgcgctggggaaccaggagggcagcctgaagaccgccctcaccggggccatgcgggtcaccaaggacacgaacgacaacaacctgtacaagctgcacggcgggcacgtgtcctgccgcgtgaagctcagcgccctgaccctgaagggcacctcctacaagatctgcaccgacaagatgttcttcgtcaagaaccccacggacaccggccacgggaccgtggtgatgcaggtcaaggtgagcaagggcgcgccctgccggatccccgtgatcgtcgccgacgacctcaccgccgccatcaacaaggggatcctggtgaccgtgaacccgatcgcctccacgaacgacgacgaggtcctgatcgaggtgaacccgcccttcggcgacagctacatcatcgtgggccgcggggactcccggctcacctaccagtggcacaaggagggcagctccatcgggaagctgttcacccagaccatgaagggcgtcgagcgcctggcggtgatgggggacacggcctgggacttcagctccgccggcggcttcttcaccagcgtggggaagggcatccacaccgtcttcgggtccgccttccagggcctcttcgggggcctgaactggatcaccaaggtgatcatgggcgccgtgctgatctgggtcgggatcaacacgcggaacatgaccatgagcatgtccatgatcctggtgggcgtgatcatgatgttcctcagcctgggggtcggcgcggaccaggggtgcgccatcaacttcggcaagcgcgagctgaagtgcggcgacgggatcttcatcttccgggactccgacgactggctcaacaagtacagctactaccccgaggaccccgtgaagctggccagcatcgtgaaggcctccttcgaggagggcaagtgcgggctgaacagcgtcgactccctcgagcacgagatgtggcgcagccgggccgacgagatcaacgcgatcttcgaggagaacgaggtggacatctccgtggtcgtgcaggaccccaagaacgtgtaccagcgcggcacccaccccttcagccggatccgcgacgggctgcagtacggctggaagacctggggcaagaacctggtcttctcccccgggcggaagaacggcagcttcatcatcgacgggaagtcccgcaaggagtgcccgttcagcaaccgggtgtggaactccttccagatcgaggagttcggcacgggcgtgttcaccacccgcgtctacatggacgccgtgttcgagtacaccatcgactgcgacgggagcatcctcggcgccgccgtgaacgggaagaagtccgcgcacggcagccccacgttctggatggggtcccacgaggtcaacggcacctggatgatccacaccctggaggccctggactacaaggagtgcgagtggcccctcacccacacgatcggcaccagcgtggaggagtccgagatgttcatgccccggagcatcgggggcccggtgagctcccacaaccacatccccgggtacaaggtccagaccaacggcccctggatgcaggtcccgctggaggtgaagcgcgaggcctgccccgggaccagcgtgatcatcgacggcaactgcgacggccgcgggaagtccacgcggagcaccaccgactccggcaaggtgatccccgagtggtgctgccgcagctgcaccatgcccccggtctccttccacgggagcgacggctgctggtaccccatggagatccggccccgcaagacgcacgagtcccacctggtgcggagctgggtgaccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 401 - RNA, 10453 nt, synthetic construct
  misc_feature 1..10453: note = mRNA product Design1 comprising derived and/or modified sequence from YFV 17D__NC_002031.1__polyprotein (CDS opt2)
  source 1..10453: mol_type = other RNA
gggagaaagcttaccatgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgccggcgagatccacgccgtccccttcggcctcgtctccatgatgatcgccatggaggtcgtcctccgcaagcgccagggccccaagcagatgctcgtcggcggcgtcgtcctcctcggcgccatgctcgtcggccaggtcaccctcctcgacctcctcaagctcaccgtcgccgtcggcctccacttccacgagatgaacaacggcggcgacgccatgtacatggccctcatcgccgccttctccatccgccccggcctcctcatcggcttcggcctccgcaccctctggtccccccgcgagcgcctcgtcctcaccctcggcgccgccatggtcgagatcgccctcggcggcgtcatgggcggcctctggaagtacctcaacgccgtctccctctgcatcctcaccatcaacgccgtcgcctcccgcaaggcctccaacaccatcctccccctcatggccctcctcacccccgtcaccatggccgaggtccgcctcgccgccatgttcttctgcgccgtcgtcatcatcggcgtcctccaccagaacttcaaggacacctccatgcagaagaccatccccctcgtcgccctcaccctcacctcctacctcggcctcacccagcccttcctcggcctctgcgccttcctcgccacccgcatcttcggccgccgctccatccccgtcaacgaggccctcgccgccgccggcctcgtcggcgtcctcgccggcctcgccttccaggagatggagaacttcctcggccccatcgccgtcggcggcctcctcatgatgctcgtctccgtcgccggccgcgtcgacggcctcgagctcaagaagctcggcgaggtctcctgggaggaggaggccgagatctccggctcctccgcccgctacgacgtcgccctctccgagcagggcgagttcaagctcctctccgaggagaaggtcccctgggaccaggtcgtcatgacctccctcgccctcgtcggcgccgccctccaccccttcgccctcctcctcgtcctcgccggctggctcttccacgtccgcggcgcccgccgctccggcgacgtcctctgggacatccccacccccaagatcatcgaggagtgcgagcacctcgaggacggcatctacggcatcttccagtccaccttcctcggcgcctcccagcgcggcgtcggcgtcgcccagggcggcgtcttccacaccatgtggcacgtcacccgcggcgccttcctcgtccgcaacggcaagaagctcatcccctcctgggcctccgtcaaggaggacctcgtcgcctacggcggctcctggaagctcgagggccgctgggacggcgaggaggaggtccagctcatcgccgccgtccccggcaagaacgtcgtcaacgtccagaccaagccctccctcttcaaggtccgcaacggcggcgagatcggcgccgtcgccctcgactacccctccggcacctccggctcccccatcgtcaaccgcaacggcgaggtcatcggcctctacggcaacggcatcctcgtcggcgacaactccttcgtctccgccatctcccagaccgaggtcaaggaggagggcaaggaggagctccaggagatccccaccatgctcaagaagggcatgaccaccgtcctcgacttccaccccggcgccggcaagacccgccgcttcctcccccagatcctcgccgagtgcgcccgccgccgcctccgcaccctcgtcctcgcccccacccgcgtcgtcctctccgagatgaaggaggccttccacggcctcgacgtcaagttccacacccaggccttctccgcccacggctccggccgcgaggtcatcgacgccatgtgccacgccaccctcacctaccgcatgctcgagcccacccgcgtcgtcaactgggaggtcatcatcatggacgaggcccacttcctcgaccccgcctccatcgccgcccgcggctgggccgcccaccgcgcccgcgccaacgagtccgccaccatcctcatgaccgccaccccccccggcacctccgacgagttcccccactccaacggcgagatcgaggacgtccagaccgacatcccctccgagccctggaacaccggccacgactggatcctcgccgacaagcgccccaccgcctggttcctcccctccatccgcgccgccaacgtcatggccgcctccctccgcaaggccggcaagtccgtcgtcgtcctcaaccgcaagaccttcgagcgcgagtaccccaccatcaagcagaagaagcccgacttcatcctcgccaccgacatcgccgagatgggcgccaacctctgcgtcgagcgcgtcctcgactgccgcaccgccttcaagcccgtcctcgtcgacgagggccgcaaggtcgccatcaagggccccctccgcatctccgcctcctccgccgcccagcgccgcggccgcatcggccgcaaccccaaccgcgacggcgactcctactactactccgagcccacctccgagaacaacgcccaccacgtctgctggctcgaggcctccatgctcctcgacaacatggaggtccgcggcggcatggtcgcccccctctacggcgtcgagggcaccaagacccccgtctcccccggcgagatgcgcctccgcgacgaccagcgcaaggtcttccgcgagctcgtccgcaactgcgacctccccgtctggctctcctggcaggtcgccaaggccggcctcaagaccaacgaccgcaagtggtgcttcgagggccccgaggagcacgagatcctcaacgactccggcgagaccgtcaagtgccgcgcccccggcggcgccaagaagcccctccgcccccgctggtgcgacgagcgcgtctcctccgaccagtccgccctctccgagttcatcaagttcgccgagggccgccgcggcgccgccgaggtcctcgtcgtcctctccgagctccccgacttcctcgccaagaagggcggcgaggccatggacaccatctccgtcttcctccactccgaggagggctcccgcgcctaccgcaacgccctctccatgatgcccgaggccatgaccatcgtcatgctcttcatcctcgccggcctcctcacctccggcatggtcatcttcttcatgtcccccaagggcatctcccgcatgtccatggccatgggcaccatggccggctgcggctacctcatgttcctcggcggcgtcaagcccacccacatctcctacgtcatgctcatcttcttcgtcctcatggtcgtcgtcatccccgagcccggccagcagcgctccatccaggacaaccaggtcgcctacctcatcatcggcatcctcaccctcgtctccgccgtcgccgccaacgagctcggcatgctcgagaagaccaaggaggacctcttcggcaagaagaacctcatcccctcctccgcctccccctggtcctggcccgacctcgacctcaagcccggcgccgcctggaccgtctacgtcggcatcgtcaccatgctctcccccatgctccaccactggatcaaggtcgagtacggcaacctctccctctccggcatcgcccagtccgcctccgtcctctccttcatggacaagggcatccccttcatgaagatgaacatctccgtcatcatgctcctcgtctccggctggaactccatcaccgtcatgcccctcctctgcggcatcggctgcgccatgctccactggtccctcatcctccccggcatcaaggcccagcagtccaagctcgcccagcgccgcgtcttccacggcgtcgccgagaaccccgtcgtcgacggcaaccccaccgtcgacatcgaggaggcccccgagatgcccgccctctacgagaagaagctcgccctctacctcctcctcgccctctccctcgcctccgtcgccatgtgccgcacccccttctccctcgccgagggcatcgtcctcgcctccgccgccctcggccccctcatcgagggcaacacctccctcctctggaacggccccatggccgtctccatgaccggcgtcatgcgcggcaaccactacgccttcgtcggcgtcatgtacaacctctggaagatgaagaccggccgccgcggctccgccaacggcaagaccctcggcgaggtctggaagcgcgagctcaacctcctcgacaagcgccagttcgagctctacaagcgcaccgacatcgtcgaggtcgaccgcgacaccgcccgccgccacctcgccgagggcaaggtcgacaccggcgtcgccgtctcccgcggcaccgccaagctccgctggttccacgagcgcggctacgtcaagctcgagggccgcgtcatcgacctcggctgcggccgcggcggctggtgctactacgccgccgcccagaaggaggtctccggcgtcaagggcttcaccctcggccgcgacggccacgagaagcccatgaacgtccagtccctcggctggaacatcatcaccttcaaggacaagaccgacatccaccgcctcgagcccgtcaagtgcgacaccctcctctgcgacatcggcgagtcctcctcctcctccgtcaccgagggcgagcgcaccgtccgcgtcctcgacaccgtcgagaagtggctcgcctgcggcgtcgacaacttctgcgtcaaggtcctcgccccctacatgcccgacgtcctcgagaagctcgagctcctccagcgccgcttcggcggcaccgtcatccgcaaccccctctcccgcaactccacccacgagatgtactacgtctccggcgcccgctccaacgtcaccttcaccgtcaaccagacctcccgcctcctcatgcgccgcatgcgccgccccaccggcaaggtcaccctcgaggccgacgtcatcctccccatcggcacccgctccgtcgagaccgacaagggccccctcgacaaggaggccatcgaggagcgcgtcgagcgcatcaagtccgagtacatgacctcctggttctacgacaacgacaacccctaccgcacctggcactactgcggctcctacgtcaccaagacctccggctccgccgcctccatggtcaacggcgtcatcaagatcctcacctacccctgggaccgcatcgaggaggtcacccgcatggccatgaccgacaccacccccttcggccagcagcgcgtcttcaaggagaaggtcgacacccgcgccaaggacccccccgccggcacccgcaagatcatgaaggtcgtcaaccgctggctcttccgccacctcgcccgcgagaagaacccccgcctctgcaccaaggaggagttcatcgccaaggtccgctcccacgccgccatcggcgcctacctcgaggagcaggagcagtggaagaccgccaacgaggccgtccaggaccccaagttctgggagctcgtcgacgaggagcgcaagctccaccagcagggccgctgccgcacctgcgtctacaacatgatgggcaagcgcgagaagaagctctccgagttcggcaaggccaagggctcccgcgccatctggtacatgtggctcggcgcccgctacctcgagttcgaggccctcggcttcctcaacgaggaccactgggcctcccgcgagaactccggcggcggcgtcgagggcatcggcctccagtacctcggctacgtcatccgcgacctcgccgccatggacggcggcggcttctacgccgacgacaccgccggctgggacacccgcatcaccgaggccgacctcgacgacgagcaggagatcctcaactacatgtccccccaccacaagaagctcgcccaggccgtcatggagatgacctacaagaacaaggtcgtcaaggtcctccgccccgcccccggcggcaaggcctacatggacgtcatctcccgccgcgaccagcgcggctccggccaggtcgtcacctacgccctcaacaccatcaccaacctcaaggtccagctcatccgcatggccgaggccgagatggtcatccaccaccagcacgtccaggactgcgacgagtccgtcctcacccgcctcgaggcctggctcaccgagcacggctgcgaccgcctcaagcgcatggccgtctccggcgacgactgcgtcgtccgccccatcgacgaccgcttcggcctcgccctctcccacctcaacgccatgtccaaggtccgcaaggacatctccgagtggcagccctccaagggctggaacgactgggagaacgtccccttctgctcccaccacttccacgagctccagctcaaggacggccgccgcatcgtcgtcccctgccgcgagcaggacgagctcatcggccgcggccgcgtctcccccggcaacggctggatgatcaaggagaccgcctgcctctccaaggcctacgccaacatgtggtccctcatgtacttccacaagcgcgacatgcgcctcctctccctcgccgtctcctccgccgtccccacctcctgggtcccccagggccgcaccacctggtccatccacggcaagggcgagtggatgaccaccgaggacatgctcgaggtctggaaccgcgtctggatcaccaacaacccccacatgcaggacaagaccatggtcaagaagtggcgcgacgtcccctacctcaccaagcgccaggacaagctctgcggctccctcatcggcatgaccaaccgcgccacctgggcctcccacatccacctcgtcatccaccgcatccgcaccctcatcggccaggagaagtacaccgactacctcaccgtcatggaccgctactccgtcgacgccgacctccagctcggcgagctcatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 402 - RNA, 2554 nt, synthetic construct
  misc_feature 1..2554: note = mRNA product Design1 comprising derived and/or modified sequence from YFV 17D__NC_002031.1__C-prME (CDS opt2)
  source 1..2554: mol_type = other RNA
gggagaaagcttaccatgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 403 - RNA, 3610 nt, synthetic construct
  misc_feature 1..3610: note = mRNA product Design1 comprising derived and/or modified sequence from YFV 17D__NC_002031.1__C-prME-NS1 (CDS opt2)
  source 1..3610: mol_type = other RNA
gggagaaagcttaccatgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 404 - RNA, 2311 nt, synthetic construct
  misc_feature 1..2311: note = mRNA product Design1 comprising derived and/or modified sequence from YFV 17D__NC_002031.1__X-SS-prME-XX (CDS opt2)
  source 1..2311: mol_type = other RNA
gggagaaagcttaccatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 405 - RNA, 1801 nt, synthetic construct
  misc_feature 1..1801: note = mRNA product Design1 comprising derived and/or modified sequence from YFV 17D__NC_002031.1__X-SS-E (CDS opt2)
  source 1..1801: mol_type = other RNA
gggagaaagcttaccatgcgcggcctctcctcccgcaagcgccgctcccacgacgtcctcaccgtccagttcctcatcctcggcatgctcctcatgaccggcggcgtcaccctcgtcgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 406 - RNA, 1831 nt, synthetic construct
  misc_feature 1..1831: note = mRNA product Design1 comprising derived and/or modified sequence from YFV 17D__NC_002031.1__X-SS-E-XX (CDS opt2)
  source 1..1831: mol_type = other RNA
gggagaaagcttaccatgcgcggcctctcctcccgcaagcgccgctcccacgacgtcctcaccgtccagttcctcatcctcggcatgctcctcatgaccggcggcgtcaccctcgtcgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 407 - RNA, 2248 nt, synthetic construct
  misc_feature 1..2248: note = mRNA product Design1 comprising derived and/or modified sequence from YFV 17D__NC_002031.1__SS-prME (CDS opt2)
  source 1..2248: mol_type = other RNA
gggagaaagcttaccatggacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 408 - RNA, 3304 nt, synthetic construct
  misc_feature 1..3304: note = mRNA product Design1 comprising derived and/or modified sequence from YFV 17D__NC_002031.1__SS-prME-NS1 (CDS opt2)
  source 1..3304: mol_type = other RNA
gggagaaagcttaccatggacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 409 - RNA, 10453 nt, synthetic construct
  misc_feature 1..10453: note = mRNA product Design1 comprising derived and/or modified sequence from YFV 17D__NC_002031.1__polyprotein (CDS opt3)
  source 1..10453: mol_type = other RNA
gggagaaagcttaccatgagcggcaggaaggcccaggggaaaaccctgggagtgaacatggtcaggcggggtgttcgctccctctctaataagatcaaacagaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagcctgatgagaggacttagctccaggaaacggcgctctcatgatgttctgaccgtgcagtttttgatcctcggcatgctgctgatgacaggcggggtcactctcgtgcgaaagaacagatggttactgcttaatgtaacctcggaagacttgggaaagacattctcagttggtaccggcaactgcactacaaatattctggaagcgaaatactggtgtccggatagcatggaatataactgccccaatctaagtcctagggaagaaccggacgatatcgactgttggtgctacggggtggaaaacgtccgggtggcttatggaaagtgtgattccgccggccgttctcgcagaagcaggcgggcaattgacctccccacccacgaaaatcatggtctgaaaacgcgacaggaaaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaaaggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccaaactatgaaaggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcagaccagggctgtgctatcaacttcggtaagagggaattgaaatgcggggatggaatattcatctttcgcgactccgatgactggctgaataagtactcatattaccccgaggatccagttaagctcgccagtattgtgaaagcgtctttcgaagagggcaagtgtggtctgaacagcgtagactccttagagcatgaaatgtggcggtcaagagccgacgagatcaatgctatttttgaagagaacgaagtggatatcagcgtcgtggttcaggaccctaaaaatgtgtaccaaaggggcacccaccccttctctcgaatacgcgatgggctgcagtatggatggaagacatggggcaaaaaccttgtcttttccccagggcggaagaatggaagtttcattatcgacggcaagagcagaaaagagtgccccttttctaacagggtgtggaactccttccagattgaggaatttggtactggggttttcaccacacgtgtgtacatggatgcagtctttgagtatactatcgactgtgatggatcaatattgggcgccgctgtaaacggtaagaaaagtgcccacggcagccctaccttctggatggggtcgcatgaagtgaatggaacgtggatgatccacacactcgaggcactggactacaaggaatgcgagtggccactaacccatactattggcacatccgttgaggaatctgagatgtttatgccgcgcagcatcgggggacccgtgtcaagtcacaaccacattcctggctataaagtccagaccaatggtccatggatgcaagtgcccctggaagtaaagcgggaggcgtgtcctgggacttccgtgatcatagatggaaactgcgacggcagaggcaagtctaccaggagcacaacggattccgggaaagtcattccagaatggtgctgtcgatcatgcaccatgcccccggttagcttccatggaagtgacggttgttggtaccctatggagatccggccacgcaagactcacgagtctcatctcgtgagatcctgggtgacagccggcgaaatccacgctgtccccttcgggctggtgagcatgatgattgccatggaggttgtacttaggaaacggcagggacctaagcagatgttggtgggcggtgtcgtgctgttaggggcaatgctcgttggacaagtgaccctgcttgatctgttgaaactcacagtcgctgtgggcctgcattttcacgaaatgaataacggcggggacgccatgtatatggcactaatcgccgctttctcgattcgacccggactgctcataggttttggcctgagaactctttggtcaccacgcgagaggttggtactgaccttaggggcggccatggtcgagatcgcactcggaggcgtgatgggtgggctgtggaagtaccttaacgctgtttctctgtgcattctaacgatcaatgccgtggccagtcgtaaggcttccaacacaattctccctctgatggcattgctgacccccgtcactatggccgaagtgcggttagcggctatgttcttttgtgccgttgtgatcataggagtcctccaccagaatttcaaagacaccagcatgcagaagacaatcccactggtggcacttactctgacctcttacttgggcctcacacagccgtttctgggcctatgcgccttcctggctacgagaatttttgggaggcgcagcatccctgtaaacgaggcacttgccgcggctggactcgtgggtgttctggccggcttggcattccaagaaatggagaattttctggggcccattgccgtcggaggcttactcatgatgctggtgtccgtggctggtcgagtcgatgggcttgaactgaaaaagttgggagaggtatcatgggaggaagaggccgaaatcagtggcagctctgcaagatatgacgtggctctctccgagcagggcgagttcaaactgctatcagaggagaaggttccatgggatcaggtggtcatgaccagtctggcccttgtgggggcggccctccatcccttcgcactgttgttagttctggctggatggctctttcacgtgcggggtgccaggcgcagcggcgacgtcctgtgggatatacctactccaaaaattatcgaagagtgtgaacatcttgaggacgggatctacggaattttccagtccacatttctgggcgcttctcaacgtggtgtgggggtagcacagggaggcgtgttccacaccatgtggcatgttactagaggcgcctttttggtccggaacgggaagaagctaataccctcgtgggccagcgtgaaagaagatctggtggcttatggaggttcatggaagctcgagggaaggtgggacggggaggaagaggtccagctgatcgcggcagttcctggcaagaatgtggtaaacgtgcagacaaagccgtcccttttcaaagtccgcaatggcggtgaaattggggccgtggctttagattacccaagtggcacctctggaagccccatcgttaaccgaaatggcgaggtgattgggctgtatggaaacggtatcctcgtcggcgacaattcctttgtatcagccatatctcaaacggaggtgaaggaagaggggaaggaagagttgcaggaaatccctactatgctgaaaaagggaatgaccacagttctcgatttccacccaggcgcaggtaaaaccagacggtttctgccccagattcttgccgagtgcgctaggcgcagactgaggactttggtgctagcgcctacacgggtcgtgctgagcgagatgaaggaagccttccacgggctcgacgtcaaatttcatacccaagcattcagtgctcacggctccggacgtgaggtgatcgacgccatgtgtcatgcaacattaacttaccgcatgctggaaccgacccgagttgtgaactgggaggtaattatcatggatgaagcccactttcttgaccccgctagcatagccgcgagaggctgggcagcccacagggctcgggccaatgagtctgctacgattctgatgacagcaaccccacctgggacttcagatgagttcccccattccaacggagaaatcgaggacgtgcagaccgatatcccaagtgaaccttggaacacaggtcacgactggattctcgccgataagcgccccactgcttggttcttgccaagcatcagagccgcaaatgtcatggcggcctcgctgaggaaggctggcaaatctgttgtggtcctcaaccggaagacctttgagcgagaatatccgacgataaaacagaagaaacctgacttcattctggccacagatatcgcagagatgggggctaatctttgcgtggagagagtactagactgtcgcaccgcctttaagcccgtgctggttgatgaaggaaggaaggtggcaattaaaggcccattgcggatctccgccagctcagctgcgcagcgtagaggtaggatagggcgcaaccccaatcgggacggcgatagttactactattctgagcctacttccgaaaacaatgcccatcacgtctgctggttagaggcaagcatgctgctcgacaacatggaggtgcgaggaggcatggtcgctccactgtacggggtggaaggaacaaagacccccgtttcacctggcgagatgagacttagggacgatcaacgcaaagtattccgggaactggtgagaaattgcgacctcccggtctggttgagttggcaagtggccaaggccggtctgaaaactaacgatcgtaagtggtgttttgaggggccagaagaacatgagattctaaatgacagcggagaaacagttaagtgcagggcacccggcggtgctaaaaagcctctgcggccccgctggtgtgatgagcgagtgtcctctgaccagagcgccctctccgagttcatcaaatttgcggagggcagaagaggggctgccgaagtccttgtggtactgtcagagttaccagatttcttggcaaagaaaggaggcgaggccatggacaccatctctgtgtttctgcacagtgaagaggggtcgcgggcttatcgcaacgcactcagcatgatgcctgaagccatgacgattgttatgctgttcatccttgcgggactgctcacttccggcatggtcatatttttcatgtctcccaagggtatatcaagaatgagcatggctatggggaccatggccggatgcggctacttgatgtttctgggtggcgtgaaaccaacacacatctcctatgtgatgttaattttcttcgtcctaatggttgtggtaatccctgagccggggcagcaaaggagtatccaggataatcaggtggcatacctgattataggaatcctcacccttgtctctgccgtggctgccaacgaactgggcatgttggagaagacaaaggaggacctgtttgggaaaaagaatctcattcccagctcagcatccccatggagttggcctgatctggaccttaaacccggagctgcctggactgtttatgtgggcatcgtcaccatgctcagcccaatgctgcatcactggattaaggtggaatacggtaacttgtctctgtccgggatcgcgcagtcagccagcgtattatcgttcatggataaaggaataccttttatgaagatgaatatctctgttattatgctactggtgagtggctggaactccatcacggtcatgcccctcctttgtggcattgggtgcgcaatgctgcattggagcttgatcctgccgggaataaaggctcaacagtcaaaactcgcccagcgacgggtgttccacggtgtggcagagaacccagtcgttgacggcaatcctacagtggacattgaagaggctcccgagatgccagccctgtacgaaaagaaacttgccttatatctgctcttggcgctgtccctagcttctgtagcaatgtgtcgtactccctttagcctggccgaggggatcgtgctcgctagtgccgcacttggacctctgattgaaggcaacacctccttgctgtggaatggtccgatggccgtcagcatgacaggggtgatgagaggaaaccactacgctttcgttggcgtgatgtataatctctggaagatgaaaaccggccgcagggggtctgcgaacggaaagactctgggtgaggtctggaagcgggaattaaatcttctggataaaagacagtttgagctctacaagcgcaccgacatcgtggaggtagatagggacacagcccgacggcatctagcagaaggcaaagttgatacgggggtggctgtctcaagaggaactgccaagctgaggtggttccacgagcgcggctatgtgaaattggaaggtcgtgttatagacctggggtgcggacggggcggctggtgttactatgcagccgctcaaaaggaggtgagtggggtcaagggatttaccctcggtagagatggccatgaaaaacccatgaacgtgcagtcccttgggtggaatatcattacattcaaggacaaaaccgatatccacaggctggagccagtaaagtgcgacactttgctgtgtgatattggagagagttcttcgtcaagcgtgacagaaggcgagcgcaccgtccgagttctcgacacggtggaaaaatggttagcctgcggtgtcgacaacttttgcgtgaaggtactggcgccttacatgcccgatgtgcttgagaaactggaactactccagcggagattcgggggaactgttatcaggaatcctctgtcccgcaacagtacacatgagatgtactatgtgtctggcgcaagaagcaatgtcacctttaccgtgaaccaaacttcccggttgctgatgaggcgtatgcgacgcccaacaggcaaggttaccctcgaggccgacgtcatacttcccattgggacaagatcagtggaaactgataagggacctctggacaaagaggctatcgaggaacgggtggagaggatcaagagtgaatacatgacgtcttggttctatgataatgacaacccataccgcacctggcactattgtggtagctacgtaacaaaaacttccggctcagccgcaagcatggtcaacggggtgattaagatcttaacctatccctgggatagaatagaggaagttacacggatggctatgaccgacactacgccgttcggacagcagagggtgtttaaagagaaggtcgatacccgagccaaggaccctccagctggcacacgtaaaattatgaaggtggttaatagatggctgttccgccacttggcccgggagaagaatcccaggctctgcactaaggaggagtttatcgcaaaagtgagatctcatgcggccattggtgcttacctggaagaacaggaacaatggaagaccgccaatgaggcagtacaggatcctaagttctgggagctagtcgacgaggagcgcaaacttcaccagcaggggcggtgtaggacatgcgtgtacaacatgatgggaaagcgagagaaaaagctgtccgagtttggcaaagctaagggcagtagagccatctggtatatgtggctcggggcacggtacctggagttcgaggccttgggatttctgaatgaagatcattgggcgagcagggagaactcgggtggcggggtggagggaataggcctccaatatcttggttacgttatccgcgacctggctgccatggacgggggaggcttctatgcagatgacaccgccggctgggatactcgtattacagaagctgacttagatgacgagcaggaaatcctgaattacatgtccccacaccacaagaaattggcccaggcagtcatggagatgacgtataagaacaaagtggtaaaggtgctcagacccgctccagggggaaaagcctacatggatgtcatttctcgaagggaccagcggggttcaggccaagtggttacctacgcgctgaatactatcacaaacctaaaggtgcagcttattcgcatggctgaggccgaaatggtcatccatcaccagcatgtgcaagattgtgacgagagcgttctgaccagactcgaagcatggctgaccgagcacgggtgcgataggttgaaacggatggccgtgagtggagacgactgtgtagtccgccctatagatgacagatttggcttagctctgtcccatctcaatgcaatgtctaaggtgcgaaaggatattagcgaatggcagccctcaaaaggttggaacgactgggagaatgttccattctgctcccaccactttcatgagcttcagctgaaggatgggaggcggatcgtggtcccttgtcgtgaacaggacgagctaatcggccgcggaagagtgagtcccggcaacgggtggatgattaaagaaacagcctgcctgagcaaggcgtatgccaatatgtggtctctcatgtacttccacaaaagggatatgcggttgctgtcacttgctgtatccagcgcagtgccaacttcttgggtcccccaaggaagaacgacctggagtatacatggtaagggcgagtggatgacaactgaagacatgctggaggtttggaaccgcgtgtggatcaccaacaatcctcacatgcaggataagacaatggtgaaaaagtggcgagacgtcccatatctcaccaaaaggcaggataagttatgtgggtcgctgattggaatgactaaccgggccacgtgggcttcccatatccacttggtgattcacagaatccgtacactgataggccaggagaaatacaccgactatctcactgttatggatcgctacagcgtagacgccgaccttcaactgggtgaactaatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 410 - RNA, 2554 nt, synthetic construct
  misc_feature 1..2554: note = mRNA product Design1 comprising derived and/or modified sequence from YFV 17D__NC_002031.1__C-prME (CDS opt3)
  source 1..2554: mol_type = other RNA
gggagaaagcttaccatgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgctctcatgatgttctgaccgtgcaatttttgatcctcggcatgctgctgatgacaggcggggtcactctcgtgcgaaagaacagatggttactgcttaatgtaacctcggaggacttgggaaagacattctcagttggtaccggcaactgcactacaaatattctggaagcgaaatactggtgtccggatagcatggagtataactgccccaatctaagtcctagggaagaaccagacgatatcgactgttggtgctacggggtggaaaacgtccgggtggcttatggaaagtgtgattccgccggccgttctcgcagaagcaggcgggcaatagacctccccacccacgagaatcatggtctgaaaacgcgacaggagaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaagggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccagactatgaagggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 411 - RNA, 3610 nt, synthetic construct
  misc_feature 1..3610: note = mRNA product Design1 comprising derived and/or modified sequence from YFV 17D__NC_002031.1__C-prME-NS1 (CDS opt3)
  source 1..3610: mol_type = other RNA
gggagaaagcttaccatgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgctctcatgatgttctgaccgtgcaatttttgatcctcggcatgctgctgatgacaggcggggtcactctcgtgcgaaagaacagatggttactgcttaatgtaacctcggaggacttgggaaagacattctcagttggtaccggcaactgcactacaaatattctggaagcgaaatactggtgtccggatagcatggagtataactgccccaatctaagtcctagggaagaaccagacgatatcgactgttggtgctacggggtggaaaacgtccgggtggcttatggaaagtgtgattccgccggccgttctcgcagaagcaggcgggcaatagacctccccacccacgagaatcatggtctgaaaacgcgacaggagaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaagggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccagactatgaagggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcagaccagggctgtgctatcaacttcggtaagagggaattgaaatgcggggatggaatattcatctttcgcgactccgatgactggctgaataagtactcatattaccccgaggatccagttaagctcgccagtattgtgaaagcgtctttcgaagagggcaagtgtggtctgaacagcgtagactccttagagcatgaaatgtggcggtcaagagccgacgagatcaatgctatttttgaagagaacgaagtggatatcagcgtcgtggttcaggaccctaaaaatgtgtaccaaaggggcacccaccccttctctcgaatacgcgatgggctgcagtatggatggaagacatggggcaaaaaccttgtcttttccccagggcggaagaatggaagtttcattatcgacggcaagagcagaaaagagtgccccttttctaacagggtgtggaactccttccagattgaggaatttggtactggggttttcaccacacgtgtgtacatggatgcagtctttgagtatactatcgactgtgatggatcaatattgggcgccgctgtaaatggtaagaaaagtgcccacggcagccctaccttctggatggggtcgcatgaagtgaatggaacgtggatgatccacacactcgaggcactggactacaaggaatgcgagtggccactaacccatactattggcacatccgttgaggaatctgagatgtttatgccgcgcagcatcgggggacccgtgtcaagtcacaaccacattcctggctataaagtccagaccaatggtccatggatgcaagtgcccctggaagtaaagcgggaggcgtgtcctgggacttccgtgatcatagatggaaactgcgacggcagaggcaagtctaccaggagcacaacggattccgggaaagtcattccagaatggtgctgtcgatcatgcaccatgcccccggttagcttccatggaagtgacggttgttggtaccctatggagatccggccacgcaagactcacgagtctcatctcgtgagatcctgggtgacagcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 412 - RNA, 2311 nt, synthetic construct
  misc_feature 1..2311: note = mRNA product Design1 comprising derived and/or modified sequence from YFV 17D__NC_002031.1__X-SS-prME-XX (CDS opt3)
  source 1..2311: mol_type = other RNA
gggagaaagcttaccatgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaacaccgatatcaaaactctgaagtttgacgcattatccggctcacaggaagtagagttcattgggtacggaaaagctacactggaatgtcaggttcagaccgccgtggattttggcaacagctatatcgctgagatggaaacggagagttggatcgtcgacagacaatgggcccaggatctcacccttccttggcagtctggttccgggggcgtgtggagggagatgcatcacctggtcgaatttgagccaccgcatgcagccacaattcgggtgttggctctaggaaatcaagaaggcagcctgaagactgcgctcaccggggcaatgcgcgttacaaaggacactaacgataataacctgtacaaacttcacggaggtcacgtgtcgtgcagagtaaagctgtctgccttgaccctcaaaggcacatcctataagatatgtaccgacaaaatgtttttcgtcaagaatcccactgatacggggcatggaacagtggttatgcaagtgaaggtctcaaaaggcgctccttgcaggatcccagtgattgtagccgacgacctgaccgcagccatcaacaagggtatattagtgactgttaatcccattgctagtaccaacgatgacgaggtcctgatcgaagtgaatcctccattcggggatagctacatcattgtgggccgtggagactcccggctaacatatcagtggcacaaagagggctctagcatcgggaagctctttacccagactatgaaaggagtcgagcgactggccgttatgggtgatacagcatgggacttctcaagtgcgggcgggtttttcacgtccgtgggaaagggcattcataccgtgtttggtagcgctttccaggggctttttggcggattgaactggataactaaggtaatcatgggcgccgtcctgatttgggtggggatcaatacaagaaacatgaccatgtctatgtcaatgatcctcgttggagtgattatgatgttcctgagtcttggcgtcggtgcagatcaggggtgtgccataaattttggaaaatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 413 - RNA, 1801 nt, synthetic construct
  misc_feature 1..1801: note = mRNA product Design1 comprising derived and/or modified sequence from YFV 17D__NC_002031.1__X-SS-E (CDS opt3)
  source 1..1801: mol_type = other RNA
gggagaaagcttaccatgagaggcctgagctccaggaagcggcgctctcacgacgtgctcaccgtccagttccttatcctggggatgttgttaatgacaggaggtgttactctggtggcccattgcattggcataacggatcgagactttatcgagggggtacacggaggcacctgggtgtcagctacactagaacaagataaatgtgtcactgtgatggcacccgacaagcctagtctcgatattagcctggagaccgttgccatcgaccgtccagcggaagtgagaaaagtctgctacaacgctgtgcttacacatgtaaagattaatgataaatgtccgtccaccggtgaggcccacctggcagaagagaacgagggggacaatgcctgcaagaggacttattctgatcggggatggggcaacggctgtgggttgttcggaaagggttcgatcgttgcttgcgcaaaatttacatgtgccaagtcaatgagcctcttcgaagtggaccagaccaaaatacagtacgtcatccgcgctcagctgcatgtgggcgccaagcaagagaattggaacacggatattaaaactctgaagtttgacgcgctcagtgggtcccaggaagtggagttcatcggatatggcaaggcaaccttagagtgccaggtccagacagccgttgattttggtaattcttacattgctgaaatggagactgaaagctggatcgtggacagacaatgggcccaggacctgacccttccctggcagtccgggtcaggaggcgtatggagggagatgcaccacttggtggagttcgaacctccacatgcagctacaatacgggtcctggccctaggcaaccaggaggggagtctcaaaaccgcgctgacgggagccatgcgcgtgactaaggatacaaatgacaacaatctttataaactgcacggtggccatgttagctgtcgagtgaagttgtctgcactcaccctgaaagggacttcctacaagatttgcacagataaaatgtttttcgtcaagaaccccaccgacacgggacacggcaccgtggtaatgcaagttaaggtgtcaaaaggtgctccttgtagaatcccagtcattgtggccgatgacttaacagctgccatcaataaggggatcctggtcactgtgaaccccattgcaagcaccaatgatgacgaagttctcatagaggtgaaccctccatttggcgatagttatatcattgtaggaaggggcgactctcggcttacataccagtggcacaaagaagggtccagcatcggaaagctgttcactcagaccatgaaaggtgtcgagcgtttggccgtgatgggcgatacagcttgggacttttcgtctgcagggggattcttcacctccgttggcaagggtatacatactgtgtttgggtcagcgttccaaggcctatttggaggcctgaactggattacgaaggtcatcatgggggccgtgctcatctgggtaggaattaatacacgcaacatgaccatgagtatgagcatgatcctggtgggtgttattatgatgttcctttccctgggcgtcggggcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 414 - RNA, 1831 nt, synthetic construct
  misc_feature 1..1831: note = mRNA product Design1 comprising derived and/or modified sequence from YFV 17D__NC_002031.1__X-SS-E-XX (CDS opt3)
  source 1..1831: mol_type = other RNA
gggagaaagcttaccatgagaggcctgagctccaggaagcggcgctctcacgacgtgctcaccgtccagttccttatcctggggatgttgttaatgacaggaggtgttactctggtggcccattgcattggcataacggatcgagactttatcgagggggtacacggaggcacctgggtgtcagctacactagaacaagataaatgtgtcactgtgatggcacccgacaagcctagtctcgatattagcctggagaccgttgccatcgaccgtccagcggaagtgagaaaagtctgctacaacgctgtgcttacacatgtaaagattaatgataaatgtccgtccaccggtgaggcccacctggcagaagagaacgagggggacaatgcctgcaagaggacttattctgatcggggatggggcaacggctgtgggttgttcggaaagggttcgatcgttgcttgcgcaaaatttacatgtgccaagtcaatgagcctcttcgaagtggaccagaccaaaatacagtacgtcatccgcgctcagctgcatgtgggcgccaagcaagagaattggaacacggatattaaaactctgaagtttgacgcgctcagtgggtcccaggaagtggagttcatcggatatggcaaggcaaccttagagtgccaggtccagacagccgttgattttggtaattcttacattgctgaaatggagactgaaagctggatcgtggacagacaatgggcccaggacctgacccttccctggcagtccgggtcaggaggcgtatggagggagatgcaccacttggtggagttcgaacctccacatgcagctacaatacgggtcctggccctaggcaaccaggaggggagtctcaaaaccgcgctgacgggagccatgcgcgtgactaaggatacaaatgacaacaatctttataaactgcacggtggccatgttagctgtcgagtgaagttgtctgcactcaccctgaaagggacttcctacaagatttgcacagataaaatgtttttcgtcaagaaccccaccgacacgggacacggcaccgtggtaatgcaagttaaggtgtcaaaaggtgctccttgtagaatcccagtcattgtggccgatgacttaacagctgccatcaataaggggatcctggtcactgtgaaccccattgcaagcaccaatgatgacgaagttctcatagaggtgaaccctccatttggcgatagttatatcattgtaggaaggggcgactctcggcttacataccagtggcacaaagaagggtccagcatcggaaagctgttcactcagaccatgaaaggtgtcgagcgtttggccgtgatgggcgatacagcttgggacttttcgtctgcagggggattcttcacctccgttggcaagggtatacatactgtgtttgggtcagcgttccaaggcctatttggaggcctgaactggattacgaaggtcatcatgggggccgtgctcatctgggtaggaattaatacacgcaacatgaccatgagtatgagcatgatcctggtgggtgttattatgatgttcctttccctgggcgtcggggctgaccagggatgcgccataaattttggcaaatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 415 - RNA, 2248 nt, synthetic construct
  misc_feature 1..2248: note = mRNA product Design1 comprising derived and/or modified sequence from YFV 17D__NC_002031.1__SS-prME (CDS opt3)
  source 1..2248: mol_type = other RNA
gggagaaagcttaccatggacgtgctgaccgtccagttcctcatccttggcatgctgttgatgacagggggagttactttagtgagaaagaacaggtggctgctactcaatgtaacgagcgaggatctgggtaaaaccttttccgtgggcacagggaactgcactaccaatattcttgaagccaagtactggtgtcccgactctatggagtataactgccctaatctgtcaccacgggaggaaccggatgacatagattgttggtgctacggagtcgaaaacgtgcgcgttgcttatggcaaatgtgacagtgcaggtcgaagccgtagatccaggcgggccatcgatttgcccacacacgagaatcatgggctcaagacccgccaagagaaatggatgactggaagaatgggcgaaaggcagctgcagaagattgagcggtggttcgtgcgcaaccctttcttcgcggtcacagctctgaccatcgcctacctcgtgggctctaatatgacgcagcgagtagttattgcattactggtgcttgccgtcgggccagcttattcggcacactgcatcggaataactgacagagattttatcgaaggtgtgcatggcgggacctgggtgtcagccacattggagcaagacaagtgtgtcactgttatggctcccgataaacctagcctggacattagtctagagaccgtggccatcgataggccagcggaagtacggaaggtgtgctacaacgcagtcctcacacacgtgaaaattaatgacaagtgtccctccaccggagaggcccatctggctgaagagaacgaaggcgacaatgcctgcaaacgtacgtattctgatcgcggttgggggaacggatgtggccttttcggcaaggggagcatcgttgcatgcgctaagtttacttgcgccaaatccatgtcactgttcgaggtggaccagacaaagatacagtacgtcattagagcgcagttgcacgtgggagccaaacaagagaattggaacaccgatatcaagactctcaaatttgacgcactgagtggtagccaggaagtagagttcattggctacgggaaggctacattagaatgtcaggttcagaccgccgtggattttggaaactcttatatcgctgagatggaaacggagtcctggatcgtcgacaggcaatgggcccaggatctgaccctcccttggcagtcaggcagcggtggggtgtggcgggagatgcaccatcttgtcgaatttgagccaccgcacgcagccacaattcgagtgctggctttgggcaatcaagaaggaagtctaaaaactgcgctgaccggcgcaatgcgcgttacaaaggacactaacgataataacctctacaagctgcatgggggacacgtgtcttgcagagtaaaactttccgccctgaccttgaagggtacaagctataaaatatgtaccgacaagatgtttttcgtcaaaaatcccactgatacgggccacgggacagtggttatgcaagtgaaggtctcgaagggagctccttgcaggatcccagtgattgtagccgacgacctcaccgcagccatcaacaaaggcatactggtgactgttaatcccattgcttctaccaacgatgacgaggtcttaatcgaagtgaatcctccattcggtgattcctacatcattgtggggcggggcgactcacgcctgacatatcagtggcataaggagggaagtagcatcggcaaactatttacccagactatgaagggggtcgagagactcgccgttatgggagatacagcatgggacttctcctctgcgggtggctttttcacgagcgtggggaaaggcattcacaccgtgtttggatcagctttccagggtctgtttgggggccttaactggataactaaggtaatcatgggagccgtcttgatttgggtgggcatcaatacaaggaacatgaccatgagtatgtccatgatcctggttggggtgattatgatgttcctcagcctgggagtcggcgcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 416 - RNA, 3304 nt, synthetic construct
  misc_feature 1..3304: note = mRNA product Design1 comprising derived and/or modified sequence from YFV 17D__NC_002031.1__SS-prME-NS1 (CDS opt3)
  source 1..3304: mol_type = other RNA
gggagaaagcttaccatggacgtgctgaccgtccagttcctcatccttggcatgctgttgatgacagggggagttactttagtgagaaagaacaggtggctgctactcaatgtaacgagcgaggatctgggtaaaaccttttccgtgggcacagggaactgcactaccaatattcttgaagccaagtactggtgtcccgactctatggagtataactgccctaatctgtcaccacgggaagaaccggatgacatagattgttggtgctacggagtcgaaaacgtgcgcgttgcttatggcaaatgtgacagtgcaggtcgaagccgtagatccaggcgggccatcgatttgcccacacacgagaatcatgggctcaagacccgccaagagaaatggatgactggaagaatgggcgaaaggcagctgcagaagattgagcggtggttcgtgcgcaaccctttcttcgcggtcacagctctgaccatcgcctacctcgtgggctctaatatgacgcagcgagtagttattgcattactggtgcttgccgtcgggccagcttattcggcacactgcatcggaataactgacagagattttatcgaaggtgtgcatggcgggacctgggtgtcagccacattggagcaagacaagtgtgtcactgttatggctcccgataaacctagcctggacattagtctagagaccgtggccatcgataggccagcggaagtacggaaggtgtgctacaacgcagtcctcacacacgtgaaaattaatgacaagtgtccctccaccggagaggcccatctggctgaagagaacgaaggcgacaatgcctgcaaacgtacgtattctgatcgcggttgggggaacggatgtggccttttcggcaaggggagcatcgttgcatgcgctaagtttacttgcgccaaatccatgtcactgttcgaggtggaccagacaaagatacagtacgtcattagagcgcagttgcacgtgggagccaaacaagagaattggaacaccgatatcaagactctcaaatttgacgcactgagtggtagccaggaagtagagttcattggctacgggaaggctacattagaatgtcaggttcagaccgccgtggattttggaaactcttatatcgctgagatggaaacggagtcctggatcgtcgacaggcaatgggcccaggatctgaccctcccttggcagtcaggcagcggtggggtgtggcgggagatgcaccatcttgtcgaatttgagccaccgcacgcagccacaattcgagtgctggctttgggcaatcaagaaggaagtctaaaaactgcgctgaccggcgcaatgcgcgttacaaaggacactaacgataataacctctacaagctgcatgggggacacgtgtcttgcagagtaaaactttccgccctgaccttgaagggtacaagctataaaatatgtaccgacaagatgtttttcgtcaaaaatcccactgatacgggccacgggacagtggttatgcaagtgaaggtctcgaagggagctccttgcaggatcccagtgattgtagccgacgacctcaccgcagccatcaacaaaggcatactggtgactgttaatcccattgcttctaccaacgatgacgaggtcttaatcgaagtgaatcctccattcggtgattcctacatcattgtggggcggggcgactcacgcctgacatatcagtggcataaggagggaagtagcatcggcaaactatttacccagactatgaagggggtcgagagactcgccgttatgggagatacagcatgggacttctcctctgcgggtggctttttcacgagcgtggggaaaggcattcacaccgtgtttggatcagctttccagggtctgtttgggggccttaactggataactaaggtaatcatgggagccgtcttgatttgggtgggcatcaatacaaggaacatgaccatgagtatgtccatgatcctggttggggtgattatgatgttcctcagcctgggagtcggcgcagatcagggttgtgccataaattttgggaagcgtgaacttaaatgcggagacggcatcttcatttttcgggattctgacgattggctgaacaagtactcatattaccccgaggacccggtgaaattggctagtatcgttaaggccagcttcgaagagggtaaatgtggcctcaattccgtggattctctggagcatgaaatgtggcgatcgagagcagacgagattaacgctatctttgaagagaacgaagtagacataagcgtcgtggtgcaggatcctaagaatgtctaccagagggggacacaccccttctcccgcatccgggacggattacaatatggctggaagacttgggggaaaaacctggttttctcaccaggaagaaagaatggcagttttattatcgatggtaaatctaggaaggagtgccctttcagcaaccgcgtgtggaactcctttcagattgaggagttcgggaccggagtatttacgacccgagtgtacatggacgccgtcttcgagtatacaatcgattgtgacggctcaatactaggtgcggccgtgaatggcaaaaagagcgctcatgggtctcccactttttggatgggatcccacgaagttaatggcacctggatgattcacacactcgaggcactggattacaaagaatgcgagtggccacttactcataccatcgggacgagtgtggaggaaagcgagatgttcatgccccggtctattggaggccctgtctcctcacacaaccatatcccaggttataaggtgcagacaaatgggccgtggatgcaggttcccttggaagtgaagcgtgaggcctgtcctggaaccagtgtcataatcgacggcaactgcgatggtagaggcaaaagcactaggtcgacaaccgactccgggaaggtaattccagaatggtgctgtcgctcttgcactatgccccctgtgagctttcacggatcagatggctgttggtacccaatggagatccggcccagaaaaacccacgagagtcatctggttaggtcctgggtgacagcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 417 - RNA, 10453 nt, synthetic construct
  misc_feature 1..10453: note = mRNA product Design1 comprising derived and/or modified sequence from YFV 17D__NC_002031.1__polyprotein (CDS opt4)
  source 1..10453: mol_type = other RNA
gggagaaagcttaccatgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgccggcgagatccacgccgtgcccttcggcctggtgagcatgatgatcgccatggaggtggtgctgagaaagagacagggccccaagcagatgctggtgggcggcgtggtgctgctgggcgccatgctggtgggccaggtgaccctgctggacctgctgaagctgaccgtggccgtgggcctgcacttccacgagatgaacaacggcggcgacgccatgtacatggccctgatcgccgccttcagcatcagacccggcctgctgatcggcttcggcctgagaaccctgtggagccccagagagagactggtgctgaccctgggcgccgccatggtggagatcgccctgggcggcgtgatgggcggcctgtggaagtacctgaacgccgtgagcctgtgcatcctgaccatcaacgccgtggccagcagaaaggccagcaacaccatcctgcccctgatggccctgctgacccccgtgaccatggccgaggtgagactggccgccatgttcttctgcgccgtggtgatcatcggcgtgctgcaccagaacttcaaggacaccagcatgcagaagaccatccccctggtggccctgaccctgaccagctacctgggcctgacccagcccttcctgggcctgtgcgccttcctggccaccagaatcttcggcagaagaagcatccccgtgaacgaggccctggccgccgccggcctggtgggcgtgctggccggcctggccttccaggagatggagaacttcctgggccccatcgccgtgggcggcctgctgatgatgctggtgagcgtggccggcagagtggacggcctggagctgaagaagctgggcgaggtgagctgggaggaggaggccgagatcagcggcagcagcgccagatacgacgtggccctgagcgagcagggcgagttcaagctgctgagcgaggagaaggtgccctgggaccaggtggtgatgaccagcctggccctggtgggcgccgccctgcaccccttcgccctgctgctggtgctggccggctggctgttccacgtgagaggcgccagaagaagcggcgacgtgctgtgggacatccccacccccaagatcatcgaggagtgcgagcacctggaggacggcatctacggcatcttccagagcaccttcctgggcgccagccagagaggcgtgggcgtggcccagggcggcgtgttccacaccatgtggcacgtgaccagaggcgccttcctggtgagaaacggcaagaagctgatccccagctgggccagcgtgaaggaggacctggtggcctacggcggcagctggaagctggagggcagatgggacggcgaggaggaggtgcagctgatcgccgccgtgcccggcaagaacgtggtgaacgtgcagaccaagcccagcctgttcaaggtgagaaacggcggcgagatcggcgccgtggccctggactaccccagcggcaccagcggcagccccatcgtgaacagaaacggcgaggtgatcggcctgtacggcaacggcatcctggtgggcgacaacagcttcgtgagcgccatcagccagaccgaggtgaaggaggagggcaaggaggagctgcaggagatccccaccatgctgaagaagggcatgaccaccgtgctggacttccaccccggcgccggcaagaccagaagattcctgccccagatcctggccgagtgcgccagaagaagactgagaaccctggtgctggcccccaccagagtggtgctgagcgagatgaaggaggccttccacggcctggacgtgaagttccacacccaggccttcagcgcccacggcagcggcagagaggtgatcgacgccatgtgccacgccaccctgacctacagaatgctggagcccaccagagtggtgaactgggaggtgatcatcatggacgaggcccacttcctggaccccgccagcatcgccgccagaggctgggccgcccacagagccagagccaacgagagcgccaccatcctgatgaccgccaccccccccggcaccagcgacgagttcccccacagcaacggcgagatcgaggacgtgcagaccgacatccccagcgagccctggaacaccggccacgactggatcctggccgacaagagacccaccgcctggttcctgcccagcatcagagccgccaacgtgatggccgccagcctgagaaaggccggcaagagcgtggtggtgctgaacagaaagaccttcgagagagagtaccccaccatcaagcagaagaagcccgacttcatcctggccaccgacatcgccgagatgggcgccaacctgtgcgtggagagagtgctggactgcagaaccgccttcaagcccgtgctggtggacgagggcagaaaggtggccatcaagggccccctgagaatcagcgccagcagcgccgcccagagaagaggcagaatcggcagaaaccccaacagagacggcgacagctactactacagcgagcccaccagcgagaacaacgcccaccacgtgtgctggctggaggccagcatgctgctggacaacatggaggtgagaggcggcatggtggcccccctgtacggcgtggagggcaccaagacccccgtgagccccggcgagatgagactgagagacgaccagagaaaggtgttcagagagctggtgagaaactgcgacctgcccgtgtggctgagctggcaggtggccaaggccggcctgaagaccaacgacagaaagtggtgcttcgagggccccgaggagcacgagatcctgaacgacagcggcgagaccgtgaagtgcagagcccccggcggcgccaagaagcccctgagacccagatggtgcgacgagagagtgagcagcgaccagagcgccctgagcgagttcatcaagttcgccgagggcagaagaggcgccgccgaggtgctggtggtgctgagcgagctgcccgacttcctggccaagaagggcggcgaggccatggacaccatcagcgtgttcctgcacagcgaggagggcagcagagcctacagaaacgccctgagcatgatgcccgaggccatgaccatcgtgatgctgttcatcctggccggcctgctgaccagcggcatggtgatcttcttcatgagccccaagggcatcagcagaatgagcatggccatgggcaccatggccggctgcggctacctgatgttcctgggcggcgtgaagcccacccacatcagctacgtgatgctgatcttcttcgtgctgatggtggtggtgatccccgagcccggccagcagagaagcatccaggacaaccaggtggcctacctgatcatcggcatcctgaccctggtgagcgccgtggccgccaacgagctgggcatgctggagaagaccaaggaggacctgttcggcaagaagaacctgatccccagcagcgccagcccctggagctggcccgacctggacctgaagcccggcgccgcctggaccgtgtacgtgggcatcgtgaccatgctgagccccatgctgcaccactggatcaaggtggagtacggcaacctgagcctgagcggcatcgcccagagcgccagcgtgctgagcttcatggacaagggcatccccttcatgaagatgaacatcagcgtgatcatgctgctggtgagcggctggaacagcatcaccgtgatgcccctgctgtgcggcatcggctgcgccatgctgcactggagcctgatcctgcccggcatcaaggcccagcagagcaagctggcccagagaagagtgttccacggcgtggccgagaaccccgtggtggacggcaaccccaccgtggacatcgaggaggcccccgagatgcccgccctgtacgagaagaagctggccctgtacctgctgctggccctgagcctggccagcgtggccatgtgcagaacccccttcagcctggccgagggcatcgtgctggccagcgccgccctgggccccctgatcgagggcaacaccagcctgctgtggaacggccccatggccgtgagcatgaccggcgtgatgagaggcaaccactacgccttcgtgggcgtgatgtacaacctgtggaagatgaagaccggcagaagaggcagcgccaacggcaagaccctgggcgaggtgtggaagagagagctgaacctgctggacaagagacagttcgagctgtacaagagaaccgacatcgtggaggtggacagagacaccgccagaagacacctggccgagggcaaggtggacaccggcgtggccgtgagcagaggcaccgccaagctgagatggttccacgagagaggctacgtgaagctggagggcagagtgatcgacctgggctgcggcagaggcggctggtgctactacgccgccgcccagaaggaggtgagcggcgtgaagggcttcaccctgggcagagacggccacgagaagcccatgaacgtgcagagcctgggctggaacatcatcaccttcaaggacaagaccgacatccacagactggagcccgtgaagtgcgacaccctgctgtgcgacatcggcgagagcagcagcagcagcgtgaccgagggcgagagaaccgtgagagtgctggacaccgtggagaagtggctggcctgcggcgtggacaacttctgcgtgaaggtgctggccccctacatgcccgacgtgctggagaagctggagctgctgcagagaagattcggcggcaccgtgatcagaaaccccctgagcagaaacagcacccacgagatgtactacgtgagcggcgccagaagcaacgtgaccttcaccgtgaaccagaccagcagactgctgatgagaagaatgagaagacccaccggcaaggtgaccctggaggccgacgtgatcctgcccatcggcaccagaagcgtggagaccgacaagggccccctggacaaggaggccatcgaggagagagtggagagaatcaagagcgagtacatgaccagctggttctacgacaacgacaacccctacagaacctggcactactgcggcagctacgtgaccaagaccagcggcagcgccgccagcatggtgaacggcgtgatcaagatcctgacctacccctgggacagaatcgaggaggtgaccagaatggccatgaccgacaccacccccttcggccagcagagagtgttcaaggagaaggtggacaccagagccaaggacccccccgccggcaccagaaagatcatgaaggtggtgaacagatggctgttcagacacctggccagagagaagaaccccagactgtgcaccaaggaggagttcatcgccaaggtgagaagccacgccgccatcggcgcctacctggaggagcaggagcagtggaagaccgccaacgaggccgtgcaggaccccaagttctgggagctggtggacgaggagagaaagctgcaccagcagggcagatgcagaacctgcgtgtacaacatgatgggcaagagagagaagaagctgagcgagttcggcaaggccaagggcagcagagccatctggtacatgtggctgggcgccagatacctggagttcgaggccctgggcttcctgaacgaggaccactgggccagcagagagaacagcggcggcggcgtggagggcatcggcctgcagtacctgggctacgtgatcagagacctggccgccatggacggcggcggcttctacgccgacgacaccgccggctgggacaccagaatcaccgaggccgacctggacgacgagcaggagatcctgaactacatgagcccccaccacaagaagctggcccaggccgtgatggagatgacctacaagaacaaggtggtgaaggtgctgagacccgcccccggcggcaaggcctacatggacgtgatcagcagaagagaccagagaggcagcggccaggtggtgacctacgccctgaacaccatcaccaacctgaaggtgcagctgatcagaatggccgaggccgagatggtgatccaccaccagcacgtgcaggactgcgacgagagcgtgctgaccagactggaggcctggctgaccgagcacggctgcgacagactgaagagaatggccgtgagcggcgacgactgcgtggtgagacccatcgacgacagattcggcctggccctgagccacctgaacgccatgagcaaggtgagaaaggacatcagcgagtggcagcccagcaagggctggaacgactgggagaacgtgcccttctgcagccaccacttccacgagctgcagctgaaggacggcagaagaatcgtggtgccctgcagagagcaggacgagctgatcggcagaggcagagtgagccccggcaacggctggatgatcaaggagaccgcctgcctgagcaaggcctacgccaacatgtggagcctgatgtacttccacaagagagacatgagactgctgagcctggccgtgagcagcgccgtgcccaccagctgggtgccccagggcagaaccacctggagcatccacggcaagggcgagtggatgaccaccgaggacatgctggaggtgtggaacagagtgtggatcaccaacaacccccacatgcaggacaagaccatggtgaagaagtggagagacgtgccctacctgaccaagagacaggacaagctgtgcggcagcctgatcggcatgaccaacagagccacctgggccagccacatccacctggtgatccacagaatcagaaccctgatcggccaggagaagtacaccgactacctgaccgtgatggacagatacagcgtggacgccgacctgcagctgggcgagctgatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 418 - RNA, 2554 nt, synthetic construct
  misc_feature 1..2554: note = mRNA product Design1 comprising derived and/or modified sequence from YFV 17D__NC_002031.1__C-prME (CDS opt4)
  source 1..2554: mol_type = other RNA
gggagaaagcttaccatgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 419 - RNA, 3610 nt, synthetic construct
  misc_feature 1..3610: note = mRNA product Design1 comprising derived and/or modified sequence from YFV 17D__NC_002031.1__C-prME-NS1 (CDS opt4)
  source 1..3610: mol_type = other RNA
gggagaaagcttaccatgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 420 - RNA, 2311 nt, synthetic construct
  misc_feature 1..2311: note = mRNA product Design1 comprising derived and/or modified sequence from YFV 17D__NC_002031.1__X-SS-prME-XX (CDS opt4)
  source 1..2311: mol_type = other RNA
gggagaaagcttaccatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 421 - RNA, 1801 nt, synthetic construct
  misc_feature 1..1801: note = mRNA product Design1 comprising derived and/or modified sequence from YFV 17D__NC_002031.1__X-SS-E (CDS opt4)
  source 1..1801: mol_type = other RNA
gggagaaagcttaccatgagaggcctgagcagcagaaagagaagaagccacgacgtgctgaccgtgcagttcctgatcctgggcatgctgctgatgaccggcggcgtgaccctggtggcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 422 - RNA, 1831 nt, synthetic construct
  misc_feature 1..1831: note = mRNA product Design1 comprising derived and/or modified sequence from YFV 17D__NC_002031.1__X-SS-E-XX (CDS opt4)
  source 1..1831: mol_type = other RNA
gggagaaagcttaccatgagaggcctgagcagcagaaagagaagaagccacgacgtgctgaccgtgcagttcctgatcctgggcatgctgctgatgaccggcggcgtgaccctggtggcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 423 - RNA, 2248 nt, synthetic construct
  misc_feature 1..2248: note = mRNA product Design1 comprising derived and/or modified sequence from YFV 17D__NC_002031.1__SS-prME (CDS opt4)
  source 1..2248: mol_type = other RNA
gggagaaagcttaccatggacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 424 - RNA, 3304 nt, synthetic construct
  misc_feature 1..3304: note = mRNA product Design1 comprising derived and/or modified sequence from YFV 17D__NC_002031.1__SS-prME-NS1 (CDS opt4)
  source 1..3304: mol_type = other RNA
gggagaaagcttaccatggacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 425 - RNA, 10453 nt, synthetic construct
  misc_feature 1..10453: note = mRNA product Design1 comprising derived and/or modified sequence from YFV 17D__NC_002031.1__polyprotein (CDS opt5)
  source 1..10453: mol_type = other RNA
gggagaaagcttaccatgagcggcagaaaggcccaggggaaaaccctcggagtgaacatggtgcggcgcggcgttagatccctctctaataagatcaaacaaaagacaaaacagattgggaaccggcccggacctagccgcggcgtgcaggggttcatcttcttctttctgttcaatattcttacgggaaagaagatcaccgctcacctgaaaagactctggaagatgctggacccgcggcagggccttgccgtgctgcgcaaagtgaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaagacctcgggaagacattcagcgtcggaaccggcaactgcacgaccaatatcctggaagctaaatactggtgtcccgattccatggaatataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgtttgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagagggatcttccattggaaaacttttcacacaaaccatgaaaggcgtggagagactggctgtcatgggggacacagcctgggattttagctccgcgggaggcttctttacctctgttgggaagggaatccacaccgtgttcggcagcgcctttcaggggctgttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggccgaccagggatgtgctatcaacttcggcaagagagaactgaaatgcggcgatgggattttcatctttcgggactccgatgactggctcaataagtacagctattaccccgaggatcctgtgaagctggcctctatcgttaaagcctccttcgaagagggaaagtgtggccttaacagcgtggactctctggagcatgaaatgtggcgctccagagctgacgagattaatgcgatctttgaagagaacgaagtcgatattagcgtggttgtgcaggaccccaaaaatgtctaccaacgggggacacaccctttctctcgcatcagagatggactccagtatggctggaagacctgggggaaaaacctggtgtttagccccggacggaagaatggctccttcattatcgacggcaagagccgcaaagagtgcccgttttctaacagagtgtggaactccttccagatcgaggaatttgggacaggagtcttcaccacgcgggtttacatggatgccgtgtttgagtatacaattgactgtgatggcagcatcctgggggctgccgtgaacggaaagaaatccgcccacggctctcctaccttctggatggggagccatgaagtcaatggaacctggatgattcacacacttgaggctctcgactacaaggaatgcgagtggcccctgacccatacaatcggcacgtccgtggaggaatctgagatgtttatgcctcgcagcattggcgggcccgtttcctctcacaaccacatccctggatataaagtgcagaccaatggcccctggatgcaagtcccgctggaagtgaagagagaggcctgtcctgggacaagcgttatcattgatggaaactgcgacggccgggggaagtccaccagaagcacaaccgattctggaaaagtgatccccgaatggtgctgtcgctcctgcacgatgccccctgtcagcttccatggctctgacggctgttggtacccgatggagattcggcccagaaagacccacgagtcccatctcgtgcgcagctgggtcacagcgggggaaatccacgctgtgcctttcggactggtttctatgatgattgccatggaggtggtccttcggaaaagacagggccccaagcagatgctggtcggcggggttgtgctcctgggggccatgctggtcgggcaagtgacccttctcgatctgctgaaactcacagtggctgttggactgcattttcacgaaatgaataacggcggcgacgccatgtatatggcgcttatcgctgccttctccattcgccctgggctgctcatcggatttggcctgcggaccctgtggagccccagagagcgccttgtcctgacactcggggccgctatggtggagatcgccctgggaggcgtgatgggaggcctctggaagtacctgaacgctgtctccctttgcattctgaccatcaatgccgtggcgagccggaaggcctctaacacgattctccctctgatggctctgcttacacccgttaccatggccgaagtgagactggctgccatgttcttttgtgccgtcgtgatcattggcgttctccaccagaatttcaaagacaccagcatgcagaagacaatcccgctggtggctctcaccctgacgtcctaccttggcctgacacagccttttctcgggctgtgcgcgttcctggccacccggatctttggacgcagatctattcccgtcaacgaggctcttgccgccgctggcctggtgggggttctcgccggactggcgttccaagaaatggagaattttctcggccctatcgctgtcgggggactgcttatgatgctggtcagcgtggccggccgggtggatggcctggaactcaaaaagctgggggaggtctcctgggaggaagaggccgaaatttctggaagctccgctcgctatgacgttgccctttctgagcagggcgagttcaaactgctcagcgaggagaaggtgccctgggatcaggtggtcatgacatccctggcgctcgtgggggctgccctgcatccgttcgcccttctgctggttctcgctggatggctgtttcacgtgagaggcgcccggagaagcggggacgtcctttgggatatccctacccccaaaattatcgaagagtgtgaacatctggaggacggcatctacggaattttccagtctacatttctcggcgcttcccaacgcggggtgggagttgcccagggcggggtgttccacaccatgtggcatgtcacgcggggagcgtttctggtgagaaacggcaagaagctcatccctagctgggcctctgtcaaagaagatctggtggcttatgggggctcctggaaacttgagggacgctgggacggcgaggaagaggttcagctgattgccgctgtgcccgggaaaaatgtggtcaacgttcagaccaagcccagcctgttcaaagtgcggaatggaggcgaaatcggggccgtggccctcgattacccttccggaacatctggcagcccgattgtcaacagaaatggggaggtgatcggcctgtatggaaacggcattcttgttggggacaattcctttgtgagcgctatctctcaaaccgaggtcaaggaagagggaaaggaagaactccaggaaatccccacaatgctcaaaaagggcatgaccacggtgctggatttccaccctggggcgggaaaaacacgccggtttctcccccagattctggccgagtgcgctagacgcagacttcggaccctggtcctggcccctacacgcgtggttctctccgagatgaaggaagccttccacggcctggacgtgaaatttcatacccaggctttcagcgcccacggctctgggagagaggtcatcgacgcgatgtgtcatgctacccttacataccggatgctggaacccacgcgcgtggttaactgggaggtgattatcatggatgaagcccactttctcgaccctgccagcattgctgccagaggatgggcggcccaccgggctagagccaatgagtccgctaccatcctgatgacagccaccccgcccggcacatctgatgagttccctcatagcaacggggaaatcgaggacgtccagaccgatattccctccgaaccttggaacacgggacacgactggatcctggctgataagcgccccacagcctggttcctcccgtctattcgggcggccaatgtgatggctgccagccttagaaaggctggcaaatccgtggttgtcctgaaccgcaagacctttgagcgggaatatcctaccatcaaacagaagaaacccgacttcattctggccacagatatcgccgagatgggggctaatctctgcgtggagagagtgctggactgtcggaccgcgtttaagcccgtccttgttgatgaaggacgcaaggtggccatcaaaggccctctgagaattagcgcttcttccgccgcccagcggcgcggcagaatcgggcggaaccccaatcgcgacggagatagctactactattccgagcctacatctgaaaacaatgctcatcacgtgtgctggctcgaggccagcatgctgctggacaacatggaggtcagaggcgggatggtggcgccgctctacggagttgaaggcacgaagacccccgtgtcccctggggagatgcggcttcgcgacgatcaaagaaaagtcttccgggaactggtgagaaattgcgacctgcccgtttggctctcttggcaagtggccaaggctggactgaaaacaaacgatcgcaagtggtgttttgagggccctgaagaacatgagattcttaatgacagcggcgaaaccgtcaagtgccgggcccccgggggagctaaaaagccgctgagacctcgctggtgtgatgagcgggtgtccagcgaccagtctgccctctccgagttcatcaaatttgcggagggcagacgcggggccgctgaagtgctggtcgttctgagcgagctccccgatttccttgccaagaaaggaggcgaggctatggacacaatttctgtgtttctgcactccgaagaggggagccgggcctatagaaacgctctgtctatgatgcctgaagccatgaccatcgtgatgctgttcattctggcgggacttctgacgagcggcatggtcatctttttcatgtcccccaagggcatctctcgcatgagcatggccatggggaccatggctggatgcggctacctcatgtttctcgggggagtgaaacctacacacatttcctatgttatgctgatcttcttcgtgctcatggtcgtggttattcccgagccgggccagcagcggagcatccaggataatcaggtggcctaccttattatcgggatcctgaccctggtctccgctgtggccgccaacgaactcggaatgctggagaagacaaaggaggacctttttggcaaaaagaatctgattccttctagcgcgtccccctggtcttggcccgatctcgacctgaaacctggcgctgcctggaccgtttatgtggggatcgtcacaatgctgagcccgatgctccatcactggattaaggtggaatacggaaacctttccctgtctggcatcgctcagagcgcctccgtcctgagcttcatggataaagggattccctttatgaagatgaatatctctgtgatcatgctcctggtttccggatggaacagcattacggtgatgcctcttctgtgtggcatcgggtgcgccatgctccattggtctctgattctgcccggaatcaaggctcaacagtccaaactcgcccagagacgcgtcttccacggcgtggcggagaaccctgtggttgacggcaatcccaccgtggacattgaagaggcccctgagatgccggctctttacgaaaagaaactggccctgtatctcctgcttgctctgagcctcgcctctgtcgcgatgtgtcggacacccttttccctggccgaggggatcgtgctggctagcgccgctctcggacctcttattgaaggcaacacctccctgctgtggaatgggcccatggccgttagcatgaccggagtgatgagaggcaaccactacgctttcgtcggggtgatgtataatctctggaagatgaaaacaggacgcagaggctctgccaacggcaagacgctgggggaggtctggaagcgggaacttaatctgctcgataaacgccagtttgagctgtacaagagaaccgacatcgtggaggttgatcgggacacagcgagacggcatctggccgaaggaaaagtggataccggcgtcgctgtgagccgcgggacagccaagctcagatggttccacgagcggggatatgttaaacttgaaggccgcgtgatcgacctggggtgcggcagaggaggctggtgttactatgctgccgcccaaaaggaggtctccggggtgaagggatttaccctgggccgggatgggcatgaaaaacctatgaacgtgcagtctctcggatggaatattatcacgttcaaggacaaaacagatattcaccgcctggagcccgttaagtgcgacacccttctgtgtgatatcggcgagagctcctctagctccgtcaccgaaggggagagaacagtgcgggtgctcgacaccgtcgaaaaatggctggcgtgcggcgtggacaacttttgcgttaaggtgctggctccgtacatgcctgatgtcctcgagaaacttgaactgctgcagcgcagattcggaggcacagtgattcggaatcccctctctcgcaacagcacccatgagatgtactatgtttccggggccagaagcaatgtgacgtttacagtcaaccaaacctctcggctgcttatgcgcagaatgcggagacccacaggaaaggtgaccctggaggccgacgttatcctccctatcggcacgcgctccgtggaaaccgataaggggcccctggacaaagaggctattgaggaacgggtcgagagaatcaagagcgaatacatgacatcttggttctatgataatgacaacccttaccgcacctggcactattgtggatcctacgtgacaaaaaccagcggctccgccgcttctatggtgaacggggtcattaagatcctgacatatccgtgggatcggattgaggaagttaccagaatggccatgacggacacaacccccttcggccagcagcgcgtgtttaaagagaaggtggatacccgggcgaaggaccctcccgccggaacaagaaaaatcatgaaggtcgtgaatcgctggctgttccggcacctggctagagagaagaatcctcgcctttgcaccaaggaggagtttatcgccaaagttcggagccatgctgccattggcgcgtacctggaagaacaggaacaatggaagacagccaatgaggctgtgcaggatcccaagttctgggaactcgtcgacgaggagagaaaactgcaccagcaggggcggtgtagaacgtgcgtgtacaacatgatgggaaagcgcgagaagaaactttccgagtttggcaaagccaaggggagccgggctatctggtatatgtggctgggagccagatacctcgagttcgaggctctgggctttctgaatgaagatcattgggcctctcgcgagaactccgggggcggagttgagggcattgggctccaatatctgggatacgtgatcagagaccttgcggccatggacggcgggggattctatgctgatgacaccgccggctgggatacacggattaccgaagccgacctggatgacgagcaggaaatcctcaattacatgagcccgcaccacaagaaactggctcaggccgtcatggagatgacatataagaacaaagtggtcaaggtgcttcgccctgcgcccggcgggaaggcttacatggatgttatttctagacgggaccagcgcggaagcggccaagtggtcacctacgccctgaatacgatcaccaacctcaaggtgcagctgatcagaatggccgaggctgaaatggttattcatcaccagcatgtgcaagattgtgacgagtccgtcctgacacggctcgaagcctggctgaccgagcacgggtgcgatcgccttaaaagaatggctgtgtctggagacgactgtgtggttcggcctatcgatgaccgctttggcctggccctcagccatctgaatgcgatgtccaaggtcagaaaggatatttctgaatggcagcccagcaaagggtggaacgactgggagaatgtgcctttctgctcccaccactttcatgagcttcagctgaaggatggacggcgcatcgtggtcccctgtagagaacaggacgagctcattggccggggcagagtgagcccggggaacggatggatgatcaaagaaacagcctgcctgtctaaggcttatgccaatatgtggtccctgatgtacttccacaaacgcgatatgcggctcctgagccttgctgtttcctctgccgtgcctaccagctgggtcccccaaggcagaacgacatggtccatccatgggaagggagagtggatgaccacagaagacatgctggaggtgtggaaccgcgtttggattaccaacaatccccacatgcaggataagaccatggtgaaaaagtggcgggacgtcccttatctcacaaaaagacaggataagctgtgtggctctcttatcgggatgacgaaccgcgcgacctgggccagccatattcacctggtgatccaccggattagaacactcatcggacaggagaaatacaccgactatctgacagtgatggatcgctactccgttgacgctgacctgcaactcggcgaactgatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 426 - RNA, 2554 nt, synthetic construct
  misc_feature 1..2554: note = mRNA product Design1 comprising derived and/or modified sequence from YFV 17D__NC_002031.1__C-prME (CDS opt5)
  source 1..2554: mol_type = other RNA
gggagaaagcttaccatgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaggacctcgggaagacattcagcgtcggaaccggcaactgcacgaccaatatcctggaagctaaatactggtgtcccgattccatggagtataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgttcgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagaggggtcttccattggaaaacttttcacacagaccatgaagggcgtggagagactggctgtcatgggggacacagcctgggattttagctccgcgggaggcttctttacctctgttgggaagggaatccacaccgtgttcggcagcgcctttcagggcctcttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 427 - RNA, 3610 nt, synthetic construct
  misc_feature 1..3610: note = mRNA product Design1 comprising derived and/or modified sequence from YFV 17D__NC_002031.1__C-prME-NS1 (CDS opt5)
  source 1..3610: mol_type = other RNA
gggagaaagcttaccatgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaggacctcgggaagacattcagcgtcggaaccggcaactgcacgaccaatatcctggaagctaaatactggtgtcccgattccatggagtataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgttcgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagaggggtcttccattggaaaacttttcacacagaccatgaagggcgtggagagactggctgtcatgggggacacagcctgggattttagctccgcgggaggcttctttacctctgttgggaagggaatccacaccgtgttcggcagcgcctttcagggcctcttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggccgaccagggatgtgctatcaacttcggcaagagagaactgaaatgcggcgatgggattttcatctttcgggactccgatgactggctcaataagtacagctattaccccgaggatcctgtgaagctggcctctatcgttaaagcctccttcgaagagggaaagtgtggccttaacagcgtggactctctggagcatgaaatgtggcgctccagagctgacgagattaatgcgatctttgaagagaacgaagtcgatattagcgtggttgtgcaggaccccaaaaatgtctaccaacgggggacacaccctttctctcgcatcagagatggactccagtatggctggaagacctgggggaaaaacctggtgtttagccccggacggaagaatggctccttcattatcgacggcaagagccgcaaagagtgcccgttttctaacagagtgtggaactccttccagatcgaggaatttgggacaggagtcttcaccacgcgggtttacatggatgccgtgtttgagtatacaattgactgtgatggcagcatcctgggggctgccgtgaatggaaagaaatccgcccacggctctcctaccttctggatggggagccatgaagtcaatggaacctggatgattcacacacttgaggctctcgactacaaggaatgcgagtggcccctgacccatacaatcggcacgtccgtggaggaatctgagatgtttatgcctcgcagcattggcgggcccgtttcctctcacaaccacatccctggatataaagtgcagaccaatggcccctggatgcaagtcccgctggaagtgaagagagaggcctgtcctgggacaagcgttatcattgatggaaactgcgacggccgggggaagtccaccagaagcacaaccgattctggaaaagtgatccccgaatggtgctgtcgctcctgcacgatgccccctgtcagcttccatggctctgacggctgttggtacccgatggagattcggcccagaaagacccacgagtcccatctcgtgcgcagctgggtcacagcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 428 - RNA, 2311 nt, synthetic construct
  misc_feature 1..2311: note = mRNA product Design1 comprising derived and/or modified sequence from YFV 17D__NC_002031.1__X-SS-prME-XX (CDS opt5)
  source 1..2311: mol_type = other RNA
gggagaaagcttaccatgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaacaccgatatcaaaacacttaagtttgacgctctgagcggatcccaggaagtggagttcattggctacggcaaagcgaccctcgaatgtcaggtccagacagccgtggattttgggaactcttatatcgctgagatggaaaccgagagctggattgttgaccggcaatgggcccaggatctgacgctgccttggcagtccggaagcggcggggtgtggagagagatgcatcacctcgtcgagttcgagccccctcatgccgctacaatccgcgtgctggcccttggaaatcaagaaggctctctgaagaccgcgctcaccggggctatgcgggttacaaaggacaccaacgataataacctgtacaaacttcacggcggacacgtgtcctgcagagtcaagctgagcgccctcacactgaaaggcacgtcttataagatttgtaccgacaaaatgtttttcgtgaagaatcccacagataccgggcatggaacagtggttatgcaggtcaaggtgagcaaaggcgccccgtgccgcatccctgtgatcgtcgctgacgacctgaccgccgctattaacaaggggatcctcgtgacggttaatcccattgcctccaccaacgatgacgaggtgctgatcgaagtcaatcctcccttcggagattcttacattatcgtgggccggggagacagcagacttacatatcagtggcacaaagagggctccagcatcggaaagctgtttacccagacaatgaaaggcgttgagcgcctcgcggtgatgggggataccgcctgggacttctcttccgctggaggctttttcacgagcgtcgggaaggggattcatacagtgtttggctctgccttccaagggctgtttggcggactgaactggatcaccaaggttattatgggcgctgtgcttatctgggtcgggattaatacacggaacatgaccatgtccatgagcatgatcctcgtgggagtgattatgatgttcctgtccctgggcgtcggggccgatcagggatgtgcgatcaattttggcaaatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 429 - RNA, 1801 nt, synthetic construct
  misc_feature 1..1801: note = mRNA product Design1 comprising derived and/or modified sequence from YFV 17D__NC_002031.1__X-SS-E (CDS opt5)
  source 1..1801: mol_type = other RNA
gggagaaagcttaccatgagaggcctgagctcccggaagcgcagatctcacgacgtgctcaccgtccagttcctgatccttgggatgctgctcatgacaggaggcgttacgctggtggcccattgcattgggatcaccgatcgggactttattgagggagtgcacggcgggacatgggtcagcgctacccttgaacaagataaatgtgtgacagttatggcccccgacaagccttccctggatatctctctcgagaccgtggcgattgaccgcccggctgaagtcagaaaagtgtgctacaacgccgttctgacacatgtgaagatcaatgataaatgtcccagcaccggagaggcccacctggctgaagagaacgagggcgacaatgcctgcaagcggacgtattccgatcgcggctgggggaacggatgtggcctcttcgggaagggatctatcgtcgcttgcgccaaatttacctgtgccaagagcatgtccctgttcgaagtggaccagacaaaaattcagtacgtgatcagagcgcagcttcatgtcggcgctaagcaagagaattggaacaccgatattaaaacactgaagtttgacgccctcagcgggtctcaggaagttgagttcatcggatatggcaaggctaccctggagtgccaggtgcagacggccgtggattttggcaattcctacattgcggaaatggagacagaaagctggatcgtcgaccggcaatgggcccaggaccttaccctgccttggcagtctgggtccggaggcgtgtggcgcgagatgcaccacctcgttgagttcgaaccccctcatgctgccacaattagagtgctggctctggggaaccaggagggaagcctcaaaaccgccctgaccggcgccatgcgggtcacaaaggatacgaatgacaacaatctttataaactgcacgggggacatgtgtcttgtcgcgttaagctctccgctctgacccttaaaggcacaagctacaagatctgcaccgataaaatgtttttcgtgaagaaccccacagacaccggccacgggacggtcgtgatgcaagtcaaggtgtccaaaggagcgccttgtagaatcccggttattgtggccgatgacctgacagctgccatcaataagggcattctcgtcaccgtgaaccccatcgcctctaccaatgatgacgaagttctgattgaggtgaaccctccctttggggatagctatatcatcgtcggacggggcgactcccgcctgacataccagtggcacaaagaagggagctctattggcaaactcttcacccagacaatgaagggagtggagagactggctgtgatgggcgatacggcctgggacttttccagcgctgggggattcttcacctctgttggcaaggggatccatacagtctttggaagcgcgttccaaggcctttttgggggcctgaactggattaccaaggtgatcatgggagccgtgctcatttgggtcggcatcaatacacggaacatgaccatgtccatgtctatgatcctggtgggggttattatgatgttccttagcctgggagtgggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 430 - RNA, 1831 nt, synthetic construct
  misc_feature 1..1831: note = mRNA product Design1 comprising derived and/or modified sequence from YFV 17D__NC_002031.1__X-SS-E-XX (CDS opt5)
  source 1..1831: mol_type = other RNA
gggagaaagcttaccatgagaggcctgagctcccggaagcgcagatctcacgacgtgctcaccgtccagttcctgatccttgggatgctgctcatgacaggaggcgttacgctggtggcccattgcattgggatcaccgatcgggactttattgagggagtgcacggcgggacatgggtcagcgctacccttgaacaagataaatgtgtgacagttatggcccccgacaagccttccctggatatctctctcgagaccgtggcgattgaccgcccggctgaagtcagaaaagtgtgctacaacgccgttctgacacatgtgaagatcaatgataaatgtcccagcaccggagaggcccacctggctgaagagaacgagggcgacaatgcctgcaagcggacgtattccgatcgcggctgggggaacggatgtggcctcttcgggaagggatctatcgtcgcttgcgccaaatttacctgtgccaagagcatgtccctgttcgaagtggaccagacaaaaattcagtacgtgatcagagcgcagcttcatgtcggcgctaagcaagagaattggaacaccgatattaaaacactgaagtttgacgccctcagcgggtctcaggaagttgagttcatcggatatggcaaggctaccctggagtgccaggtgcagacggccgtggattttggcaattcctacattgcggaaatggagacagaaagctggatcgtcgaccggcaatgggcccaggaccttaccctgccttggcagtctgggtccggaggcgtgtggcgcgagatgcaccacctcgttgagttcgaaccccctcatgctgccacaattagagtgctggctctggggaaccaggagggaagcctcaaaaccgccctgaccggcgccatgcgggtcacaaaggatacgaatgacaacaatctttataaactgcacgggggacatgtgtcttgtcgcgttaagctctccgctctgacccttaaaggcacaagctacaagatctgcaccgataaaatgtttttcgtgaagaaccccacagacaccggccacgggacggtcgtgatgcaagtcaaggtgtccaaaggagcgccttgtagaatcccggttattgtggccgatgacctgacagctgccatcaataagggcattctcgtcaccgtgaaccccatcgcctctaccaatgatgacgaagttctgattgaggtgaaccctccctttggggatagctatatcatcgtcggacggggcgactcccgcctgacataccagtggcacaaagaagggagctctattggcaaactcttcacccagacaatgaagggagtggagagactggctgtgatgggcgatacggcctgggacttttccagcgctgggggattcttcacctctgttggcaaggggatccatacagtctttggaagcgcgttccaaggcctttttgggggcctgaactggattaccaaggtgatcatgggagccgtgctcatttgggtcggcatcaatacacggaacatgaccatgtccatgtctatgatcctggtgggggttattatgatgttccttagcctgggagtgggcgccgaccaggggtgcgctatcaattttggaaaatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 431 - RNA, 2248 nt, synthetic construct
  misc_feature 1..2248: note = mRNA product Design1 comprising derived and/or modified sequence from YFV 17D__NC_002031.1__SS-prME (CDS opt5)
  source 1..2248: mol_type = other RNA
gggagaaagcttaccatggacgtgctgaccgtccagttcctcatcctgggcatgcttctgatgacagggggagttacgctcgtgagaaagaaccggtggctgcttctgaatgtgaccagcgaggatctcggcaaaacattttccgtcgggaccggaaactgcacaaccaatattctggaagccaagtactggtgtcccgactctatggagtataactgccctaatctgagcccgcgcgaagaacccgatgacatcgattgttggtgctacggcgtggaaaacgttagagtggcttatgggaaatgtgactccgccggacggtctcgcagaagccggcgcgcgattgatctccctacacacgagaatcatggcctgaagaccagacaagagaaatggatgacgggccggatgggggaacgccagcttcagaagatcgagagatggttcgtccggaacccctttttcgctgtgaccgccctgacaattgcctacctcgttggatccaatatgacccagcgcgtggtcatcgctctgcttgtgctggccgtgggccctgcttattctgcccactgcatcgggattacagacagagattttatcgaaggagtccatggcgggacctgggttagcgcgacgctcgagcaagacaagtgtgtgacagtgatggcccccgataaaccttccctggacattagcctggagaccgtcgctatcgatcggccggccgaagtgcgcaaggtttgctacaacgctgtgctcacacacgtcaaaattaatgacaagtgtccctctaccggagaggcccatctggcggaagagaacgaaggcgacaatgcctgcaaaagaacctattccgatcggggctgggggaacggatgtggccttttcgggaagggaagcatcgtggcttgcgccaagtttacatgcgctaaatctatgtccctgttcgaggttgaccagacgaagattcagtacgtgatcagagcccagctccacgtcggcgccaaacaagagaattggaacaccgatatcaagacactgaaatttgacgctcttagcgggtctcaggaagtggagttcattggatacggcaaggcgaccctggaatgtcaggtccagacagccgtggattttggcaactcctatatcgctgagatggaaaccgagagctggattgttgaccgccaatgggcccaggatctcacgctgccttggcagtccgggtctggaggcgtgtggcgggagatgcaccatctggtcgagttcgagccccctcacgccgctacaatcagagtgctcgccctggggaatcaagaaggaagccttaaaaccgcgctgaccggcgctatgcgcgttacaaaggacaccaacgataataacctctacaagctgcatgggggccacgtgtcctgccgggtcaaacttagcgccctgacactcaagggaacgtcttataaaatttgtaccgacaagatgtttttcgtgaaaaatcccacagataccggccacgggacagtggttatgcaggtcaaggtgtccaagggagccccgtgcagaatccctgtgatcgtcgctgacgacctgaccgccgctattaacaaaggcatcctggtgacggttaatcccattgccagcaccaacgatgacgaggtgctcatcgaagtcaatcctcccttcggggattcttacattatcgtgggacgcggcgacagccggctgacatatcagtggcataaggaggggtcctctatcggcaaactttttacccagacaatgaagggagttgagagactggcggtgatgggcgataccgcctgggacttcagctccgctgggggatttttcacgagcgtcggcaaagggattcacacagtgtttggatctgccttccaaggcctctttgggggcctgaactggatcaccaaggttattatgggagctgtgctgatctgggtcggcattaatacacgcaacatgaccatgtccatgagcatgatccttgtgggggtgattatgatgttcctctctctgggagtcggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 432 - RNA, 3304 nt, synthetic construct
  misc_feature 1..3304: note = mRNA product Design1 comprising derived and/or modified sequence from YFV 17D__NC_002031.1__SS-prME-NS1 (CDS opt5)
  source 1..3304: mol_type = other RNA
gggagaaagcttaccatggacgtgctgaccgtccagttcctcatcctgggcatgcttctgatgacagggggagttacgctcgtgagaaagaaccggtggctgcttctgaatgtgaccagcgaggatctcggcaaaacattttccgtcgggaccggaaactgcacaaccaatattctggaagccaagtactggtgtcccgactctatggagtataactgccctaatctgagcccgcgcgaagaacccgatgacatcgattgttggtgctacggcgtggaaaacgttagagtggcttatgggaaatgtgactccgccggacggtctcgcagaagccggcgcgcgattgatctccctacacacgagaatcatggcctgaagaccagacaagagaaatggatgacgggccggatgggggaacgccagcttcagaagatcgagagatggttcgtccggaacccctttttcgctgtgaccgccctgacaattgcctacctcgttggatccaatatgacccagcgcgtggtcatcgctctgcttgtgctggccgtgggccctgcttattctgcccactgcatcgggattacagacagagattttatcgaaggagtccatggcgggacctgggttagcgcgacgctcgagcaagacaagtgtgtgacagtgatggcccccgataaaccttccctggacattagcctggagaccgtcgctatcgatcggccggccgaagtgcgcaaggtttgctacaacgctgtgctcacacacgtcaaaattaatgacaagtgtccctctaccggagaggcccatctggcggaagagaacgaaggcgacaatgcctgcaaaagaacctattccgatcggggctgggggaacggatgtggccttttcgggaagggaagcatcgtggcttgcgccaagtttacatgcgctaaatctatgtccctgttcgaggttgaccagacgaagattcagtacgtgatcagagcccagctccacgtcggcgccaaacaagagaattggaacaccgatatcaagacactgaaatttgacgctcttagcgggtctcaggaagtggagttcattggatacggcaaggcgaccctggaatgtcaggtccagacagccgtggattttggcaactcctatatcgctgagatggaaaccgagagctggattgttgaccgccaatgggcccaggatctcacgctgccttggcagtccgggtctggaggcgtgtggcgggagatgcaccatctggtcgagttcgagccccctcacgccgctacaatcagagtgctcgccctggggaatcaagaaggaagccttaaaaccgcgctgaccggcgctatgcgcgttacaaaggacaccaacgataataacctctacaagctgcatgggggccacgtgtcctgccgggtcaaacttagcgccctgacactcaagggaacgtcttataaaatttgtaccgacaagatgtttttcgtgaaaaatcccacagataccggccacgggacagtggttatgcaggtcaaggtgtccaagggagccccgtgcagaatccctgtgatcgtcgctgacgacctgaccgccgctattaacaaaggcatcctggtgacggttaatcccattgccagcaccaacgatgacgaggtgctcatcgaagtcaatcctcccttcggggattcttacattatcgtgggacgcggcgacagccggctgacatatcagtggcataaggaggggtcctctatcggcaaactttttacccagacaatgaagggagttgagagactggcggtgatgggcgataccgcctgggacttcagctccgctgggggatttttcacgagcgtcggcaaagggattcacacagtgtttggatctgccttccaaggcctctttgggggcctgaactggatcaccaaggttattatgggagctgtgctgatctgggtcggcattaatacacgcaacatgaccatgtccatgagcatgatccttgtgggggtgattatgatgttcctctctctgggagtcggcgccgatcaggggtgtgcgatcaattttggaaagcgggaactgaaatgcggcgacgggatcttcatttttagagattccgacgattggctcaacaagtacagctattaccccgaggaccctgttaaactggcctccatcgtgaaggcttctttcgaagagggcaaatgtggacttaatagcgtggattccctggagcatgaaatgtggcgctctcgggccgacgagattaacgctatctttgaagagaacgaagtcgacattagcgtggttgtgcaggatccgaagaatgtctaccagagaggcacccaccccttctcccggatccgcgacgggctccaatatggatggaagacatggggcaaaaacctggtgttcagccctgggagaaagaatggatcttttatcattgatggcaaatcccggaaggagtgccccttcagcaacagagtttggaactcttttcagatcgaggagttcggcacgggggtgtttaccacacgcgtctacatggacgccgtgttcgaatataccattgattgtgacggatccatcctgggcgccgctgttaatgggaaaaagagcgcgcatggatctcctacattttggatgggcagccacgaagtgaatgggacctggatgattcacacgcttgaggccctcgattacaaagaatgcgagtggcccctgacacataccatcggaacctccgtcgaggaaagcgagatgttcatgccgcggtctatcggcggccctgtgtccagccacaaccatattcccgggtataaggtgcagacaaatggaccttggatgcaggtccccctggaagttaagagagaggcttgtcctggcacctccgtgatcattgacgggaactgcgatggacgcggcaaatctacaagaagcacgaccgactccgggaaggtgatccccgaatggtgctgtcggtcttgcacaatgccgcctgtcagctttcacggatccgatggctgttggtaccccatggagattcgccccagaaaaacccacgagtctcatctcgtgcggagctgggttacagcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 433 - RNA, 10453 nt, synthetic construct
  misc_feature 1..10453: note = mRNA product Design1 comprising derived and/or modified sequence from YFV 17D__NC_002031.1__polyprotein (CDS opt6)
  source 1..10453: mol_type = other RNA
gggagaaagcttaccatgtcaggaagaaaagcacaaggaaaaaccttgggtgttaatatggtacgccgtggagtgagaagcctaagcaataaaattaaacagaaaactaaacaaattggaaacaggccggggcctagcagaggggtgcaaggttttatcttcttcttcttatttaatatcttgaccggtaagaaaataaccgcacatttaaaaaggttgtggaaaatgctagatccaaggcaaggtttagctgttttacgtaaagtcaaaagagtagtggcgagtctaatgcgtggattaagctctaggaaacgtcgatcacatgatgtgctaacagtccaattccttatcctaggtatgcttcttatgactggaggagttaccctggtaaggaaaaatcgatggttgttgctaaatgtaaccagcgaagaccttggaaaaacgttttcagtaggtacagggaactgcacaacgaatatactagaagcaaaatattggtgtcccgattctatggaatacaattgtccaaacctgtccccaagggaagaaccggatgatatagactgctggtgttacggagtggaaaacgttcgcgttgcgtatggaaaatgcgactctgctggaagaagcaggcgatcgcgtagagcaattgacctgccaacacatgaaaatcatggattaaaaacaagacaggaaaaatggatgacaggaaggatgggagaacgtcaattacagaaaatcgaacgatggtttgttcgaaatcctttctttgcagttacggcattaactatagcgtatttagtaggatcaaatatgactcaacgagtagtaatagctctattggtccttgcagttggaccagcctactcagcgcattgcataggaataacggaccgcgatttcatcgaaggagtgcatgggggaacttgggttagtgccactctagaacaagacaaatgtgtaaccgtaatggcgcccgacaaaccaagtcttgacatatcattggaaacagtagcaatcgatcgtccagcagaagtacgtaaagtttgctataatgcagtcctcactcacgtcaaaataaatgataaatgtccatcaacaggagaagcgcatctggctgaagaaaatgagggcgacaatgcttgcaaacgaacctatagtgatcgaggatggggtaatggctgcggtctttttggcaaagggtccatagtagcatgcgcgaaatttacatgtgctaaaagtatgagtctattcgaagttgaccaaacaaaaatccaatacgtaattcgagcccaattacacgtaggagctaaacaggaaaattggaacaccgatataaaaacgctcaaatttgatgcactatctggaagtcaagaagtcgaatttataggttacggtaaagcaacactagaatgtcaagttcagacagcagtcgacttcggaaattcttacatagccgaaatggaaacagaatcttggatcgtagatagacaatgggcacaggatctaaccttaccttggcaatcggggtcaggtggcgtttggcgagaaatgcaccatcttgtagagttcgaaccaccacacgctgctaccattcgagtattggccctaggaaaccaggaagggagtcttaagaccgcattaactggcgcaatgcgagtaacaaaggatactaatgataataacctttataaactacatggtgggcacgtatcatgtagagtgaaacttagtgcactcacactcaaaggaacgtcttataaaatttgcacagacaaaatgttctttgtgaaaaatcccacagacactggacatggtacagtagtaatgcaagtaaaagtatcaaaaggagccccatgcagaatacctgtaatagtagcagacgatcttacagcagccatcaataaaggtatactggtcactgtaaatccaatagcgagtacgaatgacgatgaagttttgatagaagtgaatccaccattcggcgactcatatattattgtgggtagaggagactcaagactaacttaccagtggcataaagaaggaagcagcataggaaagctgtttacgcaaactatgaaaggagtagaaaggttggcagtaatgggggataccgcttgggactttagttcagccggcggattcttcacgtcagtaggaaaaggcatacatacagtttttggatccgcctttcaaggactctttgggggcttaaactggataacgaaggtaataatgggagctgttttgatctgggtagggataaatacgcgcaacatgactatgagtatgagcatgatattagttggtgttataatgatgttcttaagccttggggtcggcgctgatcaaggttgtgctattaatttcggaaagagagaacttaagtgcggagatggaatatttatattcagagattcggacgactggctgaataaatactcatattaccccgaagaccctgtaaaactggccagcatcgtcaaagcgagctttgaagaaggtaaatgtggtcttaattcagtagactcgctcgaacacgaaatgtggcgatcacgagcagatgaaataaatgctatcttcgaagaaaatgaagtagatatcagcgttgttgtacaggatccgaagaatgtataccagcgagggacccatccattctctcgaatcagagatggtttacaatacggttggaaaacatggggcaaaaatctagtattcagcccgggaaggaaaaacggcagctttattatagacggcaaatcaaggaaagaatgccctttttctaatagagtatggaacagtttccaaatcgaagaatttggcacgggtgtatttacaacccgggtttatatggacgcagtttttgaatacacaatagactgcgacggttctatacttggtgcagcagtaaatggcaagaaaagcgcacacggatcccccacgttttggatgggatcgcatgaagtaaatggtacatggatgatccatacactagaggctttagattataaggaatgtgagtggcctcttacacacactataggaacatctgtagaggaaagcgagatgttcatgccccgcagtatcggagggccagtcagttcacataatcacatcccgggatataaagttcaaacaaatggaccatggatgcaagtaccactagaagtaaagcgagaggcttgtcccggtacgtctgtaattattgatggtaactgtgacggaaggggaaaatcaacaagaagtactaccgattccggaaaagtaattccagagtggtgctgtagatcgtgtacaatgccaccggtctcatttcacgggagtgatggatgttggtatccaatggaaatacgaccgagaaaaactcacgaaagtcacctagtgaggtcgtgggttacggctggcgaaatacacgctgtacctttcggacttgtctctatgatgatagcaatggaggtggtacttcgcaagcgccagggtcccaaacaaatgttagtaggtggcgtcgtgctattaggtgcaatgctagtcgggcaagttacactactggatttattgaaactcacagttgctgtaggtcttcatttccatgaaatgaataatggtggagacgctatgtacatggcactaattgctgctttctcaataaggcctggtttactaattggcttcggactcagaactctatggtcgccgagggagaggctggtcctaactctcggcgcggccatggtagagattgcactaggaggagttatgggcggactctggaaatatctgaatgctgtttcattgtgcattttaaccatcaatgctgtagcatcccggaaagccagtaatacaattctcccacttatggcattacttaccccggtaactatggccgaagtaagactggcagcaatgttcttttgtgcagtcgtaatcataggggttttacaccaaaattttaaggacacgtcaatgcaaaagacaatccctctagtcgctctaaccctaacatcttatctcggattaacgcaaccatttttaggtttatgtgcgttcttagcgaccagaatcttcggtagacgatcaattccagtcaatgaggctctggccgcggccggacttgtcggcgtattagcagggttagcattccaggaaatggaaaattttctaggtcctatcgccgtcggtgggctactaatgatgttagtaagcgttgcaggaagggtcgacggtttagagttgaagaaattaggggaagtatcttgggaagaagaggcggaaatatcaggatcttctgcaagatatgatgtcgctttatccgaacaaggcgagtttaaactacttagcgaagaaaaagttccatgggatcaagtagtaatgacgagccttgccttagtaggagcagctttacatccatttgcattactcttggtcttagcgggatggctgtttcacgtaagaggagcgagacgttcaggtgacgtactttgggacataccaactcccaaaatcatcgaagaatgcgaacacctggaagacggaatttacggaatattccaatcaacgtttttaggcgccagccaaaggggagtaggagtagcacaaggaggtgttttccacacaatgtggcatgttactagaggagcattccttgtgcgtaacggtaagaaattaattccgagctgggcaagcgtaaaagaagatctggttgcttacggaggatcatggaaacttgaagggcgatgggatggcgaagaggaagtgcaacttattgcagctgttcccggcaaaaatgtggtaaacgtgcaaaccaaaccttcgttatttaaagttcggaatggaggagaaataggagcagtcgccctcgattatccatcgggaacaagcggaagccctatagttaatcgaaatggagaagtcatagggctatatggaaatggtattttagtgggagataacagttttgtttcagcaattagccaaaccgaagttaaagaagaagggaaagaagaattacaggaaattcccactatgctcaagaaagggatgactacagtccttgactttcatccaggtgccgggaaaacacggcgctttttaccccaaatactcgcagaatgtgcgaggagacggttaaggacattggtgcttgcaccgactcgagtagtactaagcgaaatgaaagaggctttccacgggttagacgtcaaattccatacccaggcattttcggcacacggtagtggaagagaagtaattgatgccatgtgtcatgctacattaacctacaggatgttagaaccaacgcgcgtggtaaactgggaagttataattatggacgaagcgcactttttggacccagcttcgatcgcagcgagaggttgggcagcgcacagagctcgtgcaaacgagtcagccactattctaatgacagcaacacccccaggaacaagcgatgagttcccacattctaacggcgaaatagaagatgttcaaactgatataccctcggaaccatggaacacagggcatgattggattttggccgacaaacgacctacagcatggttcttaccgtcaattagagccgcaaacgtcatggcagccagcttgagaaaggctggtaaaagtgtggtcgtcctgaaccgcaagaccttcgagagagaatatcccaccattaaacaaaagaaacctgactttattcttgcgactgatatagcagaaatgggagccaacctctgcgtagaaagagttctagactgcaggacagcgtttaaacccgtgcttgttgatgaaggaaggaaagtagcaataaaaggaccactgcgaatctctgcttcctccgcagcacaaaggcgcggacgcatagggagaaaccctaatcgagacggagatagctattattatagtgaaccgacaagtgaaaacaatgcacaccatgtatgttggctcgaggctagtatgttattggacaatatggaagttagaggtggtatggttgcgccactgtacggagtagagggcacaaaaacacctgtatccccaggggaaatgagattgcgagacgaccaacggaaagtattcagagagctagtacgaaattgcgatcttccagtatggttaagttggcaagtcgctaaagcaggtctaaagaccaacgaccggaagtggtgttttgagggcccagaagaacatgaaatacttaatgacagcggtgaaacggtaaaatgccgtgcacctggtggagctaagaaaccactacgacccagatggtgtgatgaaagggtaagttccgatcagtctgccctgtctgaatttattaagtttgccgagggaagacggggagccgctgaagtattggtcgtattgtcggaattacctgactttttggcgaagaaaggaggagaagcgatggatacgatctctgtattcctacacagtgaagagggaagcagggcataccgcaacgcgttaagtatgatgcctgaagcaatgaccatagtaatgttatttatcttagctggtttactaacgagcggtatggtaatatttttcatgagcccaaaaggcataagcagaatgagcatggcaatgggaactatggcaggttgtggctatttaatgtttctaggtggcgttaaaccaacacatatctcttatgtaatgctaatattcttcgttctcatggtggttgtaataccggaaccaggccaacaaagatccatacaagataaccaagttgcatacctcatcatagggatattaacattggtatcagcagtagcggcaaatgaacttgggatgctggagaagacaaaagaagacctgtttggcaagaaaaatctaattccctcgtccgcatccccgtggagctggccagacttggacttaaaacccggtgctgcttggactgtgtatgtaggaattgtaacaatgttgtcccctatgttacatcattggataaaagttgaatatggtaacctaagtttatcagggattgctcaatccgcatctgttctctcatttatggataaggggataccatttatgaaaatgaacatatcggtaatcatgcttctcgttagcggttggaatagtataactgttatgccattattgtgtggcattggatgcgcaatgctccattggagcttaatacttcccggaataaaagcacaacaatctaaactggcgcagcgtcgagtattccatggcgtcgcagaaaatcctgtggttgacggaaacccgacggtggatatcgaagaagcaccggagatgcctgcactatacgagaagaaattagcactatatctgctacttgcactgagcctagcaagtgtggccatgtgtcggactccgtttagcctggcagagggaatcgtgttagctagcgcagcactcggtccacttatagaggggaatacgtcgcttctctggaatggacctatggctgtttccatgaccggcgtgatgagaggtaaccattacgcttttgtaggagtaatgtataacctttggaagatgaaaacggggcgccgtgggagtgcaaatggaaaaacactcggggaagtatggaaaagggagctgaatttactagataaacggcaattcgaactctacaaaagaacagacatagtagaagtagatagagatacagccagacgacatcttgcagaaggaaaagtagacacaggtgtagcagtgtcccgaggaacagcaaaacttcgctggtttcatgagcgaggttatgtcaaactagaaggacgggtgatagacctggggtgtggcaggggaggatggtgttattatgcagcggcacaaaaagaggttagtggagttaagggctttaccttggggcgagatggtcatgaaaagccaatgaatgtgcagtctttgggatggaacataataacattcaaagacaaaacagatattcacagattagaaccagtaaagtgtgatacattactatgtgatataggcgaaagtagctcatcgtcagtaacggaaggagaaagaacagtaagagtattagacacagttgaaaaatggctagcatgcggagtagataacttctgtgtcaaggtactcgcaccttacatgccagacgtactagaaaaactcgaactattacagcgaagatttggaggcaccgtcatacgtaacccacttagtagaaatagtacacatgagatgtactatgtttcaggcgctagatcaaatgtaacgtttacagtaaatcaaacatcgagactgcttatgcgacgaatgagaagacccaccggcaaagtcactttagaagcggacgtgattctacctattgggacccgatccgtagaaacagacaaaggtccattagacaaggaagctatcgaagagagagttgaacgcatcaagtcggaatacatgacatcttggttctatgataatgataatccctatcgtacttggcattactgtgggtcttatgtcacaaagacgagcggatctgcagctagtatggtaaacggggttataaagatattaacttatccgtgggatcgcatcgaagaagtcacgcgtatggctatgacggataccactccatttggacaacagagagtatttaaagaaaaagtagacacccgtgcaaaagatcctcctgctggcacgaggaaaataatgaaagtagtcaaccgatggctttttcgacatttggcacgcgagaaaaaccctaggttatgtacaaaagaagaatttattgccaaagtacgatcgcacgccgcaataggtgcatacctcgaggaacaagagcaatggaagactgcaaatgaggctgttcaagatccaaagttttgggagctcgtagatgaagagagaaaactacatcaacaaggcagatgtaggacatgtgtatacaacatgatggggaaacgtgaaaagaaactgagcgagttcggcaaagctaaaggtagcagggcgatatggtatatgtggctgggcgctagatatctagagttcgaagcactaggatttttgaatgaggaccactgggctagtcgagaaaattctgggggtggtgtggaaggaataggtttacaatatttaggctacgtaataagagatctcgcggctatggatggaggaggattttatgccgatgataccgctggatgggacacaagaataacagaagccgatcttgacgacgaacaagaaatcctcaattacatgagtcctcaccacaagaaacttgcacaagctgttatggaaatgacatacaaaaacaaggtagttaaagtccttcgaccagcacccggaggtaaagcatacatggacgtgatttcacggagagatcaacgtggctctgggcaagtagtgacttacgcactaaataccataaccaatttaaaggttcagctgattagaatggcagaagcagaaatggttattcaccatcaacacgttcaagattgcgatgaatctgtattgacgaggttggaggcttggttaacagaacatggttgtgatagattaaaaaggatggcagtatctggagatgattgtgttgtaaggccaatagatgatcgatttgggctagctttaagccatctgaacgctatgtcaaaagtccgaaaggatataagcgaatggcaaccatcaaaaggatggaatgactgggaaaacgtacctttttgttcacatcacttccatgagttacaactaaaagacggtcgacgaattgtcgtaccatgtagagagcaagacgaattaataggcagaggaagggtttcaccgggtaatggttggatgatcaaagaaacggcgtgtttatcaaaggcatacgctaatatgtggtctctaatgtatttccataaacgggacatgagattgctatctcttgcagtatcatcagccgtcccaacttcatgggtgccacaaggtaggacaacatggtcgattcatggaaaaggagagtggatgactacggaagatatgttagaagtatggaatagagtatggataactaacaatccacatatgcaggataagactatggtcaagaaatggcgtgatgttccgtaccttaccaaaaggcaggacaaactatgtggaagtttaataggaatgacaaatcgtgccacatgggcctcgcacattcacctggttattcatagaattagaactttaatagggcaagaaaagtacactgactatttgaccgtcatggacagatattccgtcgacgcagacctgcaactaggtgagttaatttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 434 - RNA, 2554 nt, synthetic construct
  misc_feature 1..2554: note = mRNA product Design1 comprising derived and/or modified sequence from YFV 17D__NC_002031.1__C-prME (CDS opt6)
  source 1..2554: mol_type = other RNA
gggagaaagcttaccatgagcggaaggaaagcacaaggaaaaacattgggagtaaatatggtacgtcggggagtaagatctttaagcaataaaataaaacagaaaacaaaacaaataggaaatagaccaggaccatcaagaggagtccaaggctttatattctttttcttatttaatattcttaccggaaagaaaataacagcacacctaaaaagattatggaaaatgctagatccaagacaaggtctagcagtcttaagaaaagtaaaaagagtagtagcgtccttaatgagaggacttagtagcagaaaaagaagaagccacgacgtattaaccgtacaattcctaatactagggatgctactaatgacaggaggtgtcactttagtgaggaaaaatagatggttattattaaacgttacaagtgaagatctcggaaaaacttttagcgtcggaacgggtaactgcacaacgaatatattagaagctaaatattggtgtccagactcaatggaatataattgtccaaatttaagtccacgagaggaacccgatgacatcgattgttggtgctacggcgtagaaaatgtaagagtagcatatggaaaatgcgattccgcaggcagatctagaagatcacgccgagcaatagatttaccaacacatgaaaaccatggattaaaaacgagacaagaaaaatggatgaccggaagaatgggagaaagacaattacagaaaatagaaagatggttcgtcagaaacccattctttgcggttacagcactaacaatagcatatctagtagggagtaacatgacacaaagagtcgttattgctttattggtacttgcagtaggtcccgcatattcagcacactgcattggaattacagatagagactttatagaaggggttcacgggggtacttgggtaagtgctaccctagaacaagataaatgtgtaacagtaatggcaccagacaaacctagtttagatattagcttagaaacggttgctatagatagaccagcagaagtaagaaaagtttgttacaatgcagttttaacacacgtaaaaataaacgacaaatgtccaagtaccggtgaagctcatttagcggaagaaaacgaaggcgataatgcgtgtaaaagaacatactcagatcgaggttggggtaacggatgtggtctattcggaaaaggatccattgtagcctgtgccaaatttacatgtgcaaaatcaatgagcttgtttgaagttgaccaaacaaaaattcaatatgttataagagctcaactacatgtaggcgcaaaacaagaaaattggaacactgatataaaaactcttaaatttgatgcgctaagcggaagtcaagaagtagaatttataggatatggaaaagcaacattggaatgtcaggtacaaaccgcagttgattttggcaatagttatatcgctgaaatggagactgaaagttggatagtagatagacagtgggctcaagacttgacactaccgtggcaatcaggatcaggaggtgtatggagagaaatgcatcatttagtagaatttgaaccaccacacgccgcaaccataagagtacttgcgttagggaaccaagaaggaagtctaaaaacagcactgacaggagcaatgagagtaacaaaagacacaaatgataacaatttatacaaattacatggaggacacgtatcctgcagagtaaaactaagcgctctaacattaaaaggaacgagttataaaatatgcactgacaaaatgtttttcgtcaaaaatcctacggacacagggcatggaacggtagtcatgcaagtaaaagttagtaaaggagctccatgtagaataccagtaatagtagcagacgacttaacagcggcaataaataaaggaatattggtaacagtaaatcccatagcatcaacaaatgatgatgaagtattaatagaagtaaatccaccatttggagattcatatataattgttggacgaggtgatagcagattaacttaccaatggcataaagaaggatcatcaataggaaaattgtttacgcaaaccatgaaaggagtagaaagattagcagtaatgggagacacagcatgggatttttcaagcgcagggggcttctttacaagtgtaggaaaaggaatacacactgtattcggtagtgcgttccaagggttattcggcgggttgaattggattacaaaagtaataatgggagccgtattaatatgggtaggaataaatacccgaaacatgacgatgtcaatgagtatgattcttgtaggagttataatgatgttcctaagtttaggagtaggtgcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 435 - RNA, 3610 nt, synthetic construct
  misc_feature 1..3610: note = mRNA product Design1 comprising derived and/or modified sequence from YFV 17D__NC_002031.1__C-prME-NS1 (CDS opt6)
  source 1..3610: mol_type = other RNA
gggagaaagcttaccatgtcgggaagaaaagcccaaggaaaaacactcggagtaaatatggtacgcagaggagtcaggtccctatcgaataaaattaaacagaaaaccaaacagatcggaaatcgaccaggacccagccggggcgtccaaggatttattttcttctttctatttaacatattaacaggcaagaaaatcaccgctcacttaaaaagactttggaaaatgcttgatccacgccagggattagccgtattaagaaaagtaaaaagagtagtagcaagtcttatgagaggattgagttcaagaaaaagacgatcacacgatgttctaactgtacaatttttaatcctgggaatgctattaatgacaggcggtgtaactctagtgcgtaaaaatagatggttattactaaatgtaacaagcgaagacctgggtaaaacgttttcagttggcacgggtaattgtaccactaatattctcgaagcaaaatactggtgcccagatagcatggaatacaattgcccaaatttatctccaagagaagaaccagatgacattgactgttggtgttatggtgtcgaaaacgtaagagtggcttatggaaaatgcgacagtgcgggtagaagtcgacgctcaaggcgagcaatagatctgcccactcacgagaatcatggattaaaaactcgacaagaaaaatggatgacagggagaatgggggaacgccaattgcagaaaatagaaagatggtttgtacgcaaccccttctttgccgtaacggcattaaccatagcatatctagtaggaagtaatatgacccaaagagtagtaattgcactcttagtattagcagtagggccagcttactccgcacactgtataggtataacagatagagacttcatagagggagtacatggaggtacatgggttagtgctacattagaacaagataaatgcgttacagtaatggcaccagacaaaccaagtctggacataagtctagaaacagtcgctatagatagacccgcagaagttagaaaagtttgttacaacgcagtattgacgcatgttaaaataaacgataaatgcccaagtaccggtgaggcacatcttgcagaagaaaatgaaggagataatgcttgcaaaagaacatactcagaccggggatggggaaatggttgtggtctatttggtaaaggatctatagtggcctgcgcgaaatttacatgtgcaaaatcaatgagccttttcgaagttgatcaaacaaaaattcaatatgtgatacgagcacaactacatgtaggagcaaaacaagaaaattggaatacagatataaaaacactaaaatttgacgcgttaagcggatcgcaagaagtggagttcataggctacggtaaagcaaccctagaatgccaagtccaaacagcagtagattttggaaattcatatatagcggaaatggaaacagaaagctggattgtcgatcgacaatgggctcaagacttaactctgccttggcaatcaggatcaggaggagtttggagagaaatgcatcacctagttgaatttgaacctccacatgcagcaacaataagagttctagcactaggaaatcaagaaggctcactcaaaacagcattaacaggagcaatgagagtaactaaagacacaaacgataacaacctatacaaacttcatggaggtcacgttagttgtagagttaaactatcagcgctgacgctaaaaggaacaagttataaaatttgtacagataaaatgttctttgttaaaaatccaacagacacaggtcatggaactgtcgttatgcaagtcaaagtatcaaaaggagctccatgtcggattccggttattgtggcagatgaccttactgccgctataaataaaggaattttggtaactgtaaatccaatagcatccactaatgacgatgaggtgctaatagaggtaaatcccccgtttggcgattcttacataatcgtcggaagaggagatagtagacttacgtaccaatggcataaagagggtagttccataggtaaattatttactcaaacaatgaaaggagtggaacgacttgcagtaatgggtgacacagcgtgggatttttcctcagcaggaggattctttacctcagtaggtaaaggtatacataccgtatttggttcagcctttcaaggactattcggaggtctaaattggataacaaaagtaatcatgggagcagttctcatctgggtgggcattaacacaagaaatatgactatgagtatgagtatgatattagtaggggtgattatgatgtttttatcacttggggtgggcgcagaccaaggatgtgcaataaacttcggaaaaagagaattaaaatgcggtgatggaattttcatattccgcgacagtgatgattggttgaataaatactcatattatcccgaagacccagtgaaacttgctagcatcgtaaaagcatcgtttgaagaaggaaaatgcggattaaattctgttgacagtttagaacatgagatgtggagatcaagagcggacgaaataaacgcaatatttgaagaaaatgaggtagatattagtgtagtagtacaagatcctaaaaatgtatatcaaagaggtacccacccattttcacgtattagagatggcttacaatatggatggaagacttggggaaagaatttagtattttcaccaggaaggaaaaacggtagctttataatagatggcaaatccagaaaggaatgcccattcagcaacagagtatggaacagttttcaaatagaagaatttggaacaggtgtatttacaaccagagtatatatggacgcagtgttcgaatatacaatagactgcgacggatcaatattaggagcagccgtaaatggaaagaaatcagcacacggaagtccaaccttttggatgggaagccacgaggtaaatggtacatggatgatacatacgctagaggctttagattataaagaatgcgaatggccactaacacacactatcggaacatctgtagaagaaagtgaaatgtttatgccaagaagtataggcggtccagttagtagccataatcatatacctggatataaagtacaaacgaatggaccatggatgcaagttccgttggaagtaaaaagagaagcatgccctggcacatcagtaataattgacggaaactgtgatggtcgagggaaaagtacaagaagtacaacagattcaggcaaagttataccagaatggtgttgtcgttcatgtacaatgccaccagtatcatttcatgggagtgacggatgttggtacccaatggaaataagaccaagaaaaacacatgaaagccatttagttcgatcatgggtgacagcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 436 - RNA, 2311 nt, synthetic construct
  misc_feature 1..2311: note = mRNA product Design1 comprising derived and/or modified sequence from YFV 17D__NC_002031.1__X-SS-prME-XX (CDS opt6)
  source 1..2311: mol_type = other RNA
gggagaaagcttaccatgagaggattatcaagtagaaaaagaagatcacatgatgtactaaccgtgcaatttttgatcttagggatgctcttaatgacaggaggtgttacattagtaagaaagaatcgatggctgcttttaaatgtgacatcagaggatttagggaaaacattttcggtaggaacaggaaattgtactacaaatatacttgaagcaaaatattggtgcccagactctatggaatataattgtccaaatttaagtcctagagaagaacctgacgatatagattgttggtgttatggtgtagaaaatgtaagagtagcatacggcaaatgcgatagtgcaggacgttctagacgttcaaggagagccatagatctgcccactcacgaaaatcacggattgaaaacacgacaagaaaaatggatgactgggcgaatgggagaaagacaactacagaaaattgaaagatggttcgttagaaatccattctttgccgtaacagctttaacaatagcctatttagtaggtagtaatatgacacaaagagtagtaatagcattgctagtgttagcagttggaccagcttatagtgcacattgcataggaataacagatagagactttatagaaggagtacacgggggaacttgggtaagtgccactttagaacaagataaatgtgttacagtgatggcgccagataaaccaagtctggacataagtttggaaacagtagcgattgatagacccgcagaagtaagaaaagtttgttataatgctgttctaacccatgttaaaataaatgataaatgccctagcaccggagaagcccatctagcagaagaaaatgaaggagataacgcatgtaaacgaacatactcagatagaggatggggcaacggatgtggcttgtttggaaaaggtagcatagtagcatgcgctaaatttacatgcgcaaagtcaatgtcattatttgaagtagatcaaacaaaaatacaatatgtaataagagctcaattacacgtgggtgcaaaacaagaaaattggaatacagacataaagacactaaagttcgacgcattaagtggatcacaagaggtagaatttatagggtacggaaaagcgactttagagtgtcaagtccaaacagcagtagatttcggtaactcatacatagcagaaatggaaactgaaagttggatagtagatagacaatgggcacaagacttgacactaccttggcaatcaggaagcggaggagtatggagagaaatgcatcatttagtagaatttgaaccacctcatgcagcaacaataagagtattagccctaggaaaccaagaaggaagtttaaaaacagcactaacaggagctatgagagtaacaaaagatacaaatgacaacaatctatacaaattacacggaggacatgtaagctgccgggtaaagttgagcgcactaacattaaaaggaacgagttataaaatatgcacagataaaatgttctttgttaaaaatcctacagataccggtcatggaacagtagtaatgcaagtaaaagtaagtaaaggcgctccctgtagaatacctgtaatagtcgcagacgatttaaccgcagcaataaataaaggaatattagtcacggtaaacccaatagcgtcaacaaatgatgatgaagtattaatagaagttaacccaccttttggagacagttatataatagtcggaaggggtgatagtagactaacataccaatggcataaagaaggaagctcaataggaaaattatttactcaaaccatgaaaggtgtagaaaggctagctgttatgggtgacacagcatgggatttttcaagcgcaggagggttctttacatcagtaggtaaaggaatacatacagtatttggaagtgcatttcaaggattatttggtggtttaaattggataacaaaagtaataatgggcgcagttttaatatgggtaggtataaacacaagaaatatgacaatgtctatgagtatgatattggtcggagtaataatgatgtttttatcactaggagtgggtgcagatcaaggttgcgctattaattttggaaaatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 437 - RNA, 1801 nt, synthetic construct
  misc_feature 1..1801: note = mRNA product Design1 comprising derived and/or modified sequence from YFV 17D__NC_002031.1__X-SS-E (CDS opt6)
  source 1..1801: mol_type = other RNA
gggagaaagcttaccatgagaggattaagtagccgaaaacgaagatcacatgatgtattaacagtacaatttctaattctaggaatgctgttaatgacaggaggagtgacattagttgcacattgtataggaataacagaccgagattttatagaaggtgtacatggaggcacatgggtatcagcaacattagaacaagacaaatgtgtaactgtaatggcacctgataaaccaagtctagatataagtctagaaacagtagctatagatcgaccagcagaagttagaaaagtatgttacaatgctgtactaacacacgttaaaataaatgataaatgtccaagtaccggagaagcacatttagcagaagaaaatgaaggagataacgcatgtaaaagaacttacagtgatagaggatggggaaatggatgcggtctattcggaaaaggaagtattgtagcatgtgcaaaatttacatgtgcaaaaagtatgtcattatttgaagttgaccaaactaaaatacaatacgtaattagagcacaactacacgtgggagctaaacaagaaaactggaataccgatattaaaacattaaaatttgatgcattaagcggatcacaagaagtagaatttatcggctacggaaaagcaacattggaatgccaagtacaaactgcagtagatttcgggaatagttatatagcagaaatggaaactgaaagttggattgtagataggcaatgggcacaagatttaacactgccatggcaaagcggatcaggaggggtatggagagaaatgcaccacttagttgaatttgaaccaccacatgctgcaacgattagagttctggctttaggaaatcaagaaggatcactaaaaacagccttaacaggtgcaatgagagtaaccaaagatacaaatgacaataatttatacaaattacatggaggacatgttagctgtagagtaaaactatcagcattaactttaaaagggacaagttacaaaatttgtactgataaaatgtttttcgtgaaaaatcccacagatactggtcatggcacagtagtaatgcaagtaaaagtaagtaaaggagcgccttgtaggattccagtaatagtagcagacgatttaacagcagcaataaataaaggcatcttagtaacagtaaatcccatagcatctacaaatgacgacgaagtattgatagaagtaaatccaccattcggagattcatatataattgtaggaagaggtgacagtagattgacatatcaatggcacaaagaaggaagcagtataggaaaattatttacacaaacaatgaaaggagtagaaagattagctgtcatgggagatacagcttgggatttctcaagtgcaggaggtttctttacatcagtaggaaaaggaatacatacagttttcggttcagcattccaaggattattcggaggattaaattggataacaaaagtaataatgggagcagtattaatatgggtcggaataaacacaagaaatatgacaatgtcaatgtcgatgatattagtaggtgtaataatgatgtttctaagtttgggagtaggtgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 438 - RNA, 1831 nt, synthetic construct
  misc_feature 1..1831: note = mRNA product Design1 comprising derived and/or modified sequence from YFV 17D__NC_002031.1__X-SS-E-XX (CDS opt6)
  source 1..1831: mol_type = other RNA
gggagaaagcttaccatgagagggctatcaagtagaaaaagaagatcacatgatgtattaacagtacaattcctaatactaggcatgttattaatgacaggaggagtgacgctagttgcccactgtataggaattacagaccgtgattttatagagggagtacatggaggaacatgggtaagtgcaacattagagcaagataaatgtgttacagtaatggcacctgataaacccagcttagatataagtctcgaaacagtagcaatagatagaccagcagaagtaagaaaagtttgttataacgcagtattaactcacgtaaaaataaacgataaatgtccaagcactggagaagcacatctagcagaagaaaatgaaggtgataacgcatgtaaaaggacgtatagtgatagaggatggggaaatggatgcggactattcgggaaaggaagtattgtagcatgcgctaaatttacatgtgcaaaatccatgagtttatttgaagtagatcaaacaaaaatacaatatgtaataagagcccagctacatgtcggagcaaaacaagaaaattggaatactgatataaaaacattaaaatttgatgcgctatcaggatcacaagaagtagaatttataggatatggaaaagcaactctagaatgtcaagtacaaacagcagtagactttggaaatagttacatagcagaaatggaaacagaaagttggatcgtagatagacaatgggctcaagacttaacactaccatggcaaagtggcagtggaggagtctggagagaaatgcatcacttagtagaatttgaacctcctcacgcagcaacaataagagtattagctttaggaaatcaggaaggcagtttgaaaacagcattaacgggtgctatgagagtgactaaagacactaatgataataatctttataaactacatggagggcacgtaagctgtagagttaaattaagtgcgttaacattaaaaggtacaagctacaaaatatgcacagacaaaatgttctttgtgaaaaatccaacagacacaggacatggcacagtagtaatgcaagtaaaagtatcaaaaggagcaccatgtaggataccagtaatagtcgcagatgatttaacagcagcaataaataaaggtatattagtaacagttaatcctattgcatcaactaatgatgatgaagtactaatagaagtaaacccaccgtttggagacagttacataatagtcggaagaggagacagcaggctaacatatcaatggcataaagaaggtagctcaattggaaagctattcacgcaaacaatgaaaggagtcgaaagattagcagttatgggagacacagcatgggattttagtagtgcgggagggttctttacatcagttggtaaaggtattcatacagtatttggaagtgcatttcaaggactatttggaggattaaattggataacaaaagtcatcatgggagcagtattaatatgggtaggaataaatacaagaaatatgacaatgagcatgagtatgatattagtaggagtaataatgatgtttctaagcctaggagtaggtgcagaccaaggatgtgcaatcaacttcggaaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 439 - RNA, 2248 nt, synthetic construct
  misc_feature 1..2248: note = mRNA product Design1 comprising derived and/or modified sequence from YFV 17D__NC_002031.1__SS-prME (CDS opt6)
  source 1..2248: mol_type = other RNA
gggagaaagcttaccatggatgttctaacagtacaatttttaatattagggatgttattaatgacaggaggcgtaacattagtacgaaagaatcgatggctattactaaacgttacgtctgaagatttaggaaaaacatttagcgtaggaacaggaaattgcaccacgaatatcttagaagcaaaatattggtgtccagatagtatggaatacaattgtccaaatttaagtcctagagaggaacccgacgatatagattgctggtgttacggagtggaaaatgtaagagtagcatatggaaaatgtgacagcgcaggtagaagtagaagatcacgacgagcaattgatctacccactcatgagaaccatggactaaaaacaagacaagaaaaatggatgacaggtagaatgggcgaaagacaattacagaaaatagaaagatggtttgtacgaaatcctttctttgctgtcactgcattaactatagcttatttagtaggaagtaacatgactcaaagagtagtaatagcactattagtactagcagtaggaccagcttacagtgcacactgtatagggataacggatagagattttatagaaggagtacatgggggtacatgggtgtctgccactttagaacaagacaaatgtgttacagttatggccccagataaaccctctttagacatatcattagaaactgtagcaatagatagaccggcggaagtgagaaaggtatgttataatgcagtactaacccatgtaaaaattaatgacaaatgcccatcaacaggagaggctcatctagctgaagaaaatgaaggagacaatgcttgcaaacgtacatattcagacagggggtggggaaatggatgtggattatttggtaaagggtcaatagtagcatgtgcaaaatttacatgcgcaaaaagtatgagcttatttgaagtagatcaaacaaaaatccaatatgtaattagagctcaacttcacgtaggagcaaaacaagagaattggaacacagatataaaaacattaaaatttgacgctttgtctggaagtcaagaagtcgaatttattggctatggaaaggcaacattagaatgccaagttcaaaccgcagtagattttggaaattcatacatagcagaaatggagactgaaagttggatagtagatagacagtgggctcaagacctaactttaccatggcaatcaggaagtggtggtgtatggagagaaatgcatcatttagtagaatttgaaccaccacatgcagcaacaattagagtactagcattaggaaatcaagaaggtagtttaaagacagcgcttaccggagcaatgagagttacaaaagatactaatgacaataatttatataaacttcatggaggacatgttagctgtagagtcaaattaagtgcattaacactcaaaggaacatcatacaaaatatgtacagataaaatgtttttcgtcaagaatccaacagatacaggacatggaacagttgtaatgcaagtaaaagtatcaaaaggagcaccttgcagaataccagtaatagtagcagatgatttaacagccgcaattaataaagggatattagtaacagtaaaccctatagcaagtacaaatgatgatgaagtcttgatagaagtaaatccaccatttggagattcgtatataatagtcggaagaggagatagtcgattaacatatcaatggcataaagaaggttcatcaataggaaaattatttacacaaaccatgaaaggagttgaaagattagctgtaatgggggacacagcttgggatttttctagcgcaggaggattctttacatccgtaggaaaaggtatacacacagtatttggctcagcattccaagggttatttggtggtttaaattggataacaaaagtgattatgggagcagtgctaatctgggtaggaataaatacaagaaatatgacaatgagtatgagcatgattctcgtaggagtaataatgatgttccttagtttgggagttggcgcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 440 - RNA, 3304 nt, synthetic construct
  misc_feature 1..3304: note = mRNA product Design1 comprising derived and/or modified sequence from YFV 17D__NC_002031.1__SS-prME-NS1 (CDS opt6)
  source 1..3304: mol_type = other RNA
gggagaaagcttaccatggatgtattaaccgtacaattcttaatattaggaatgctgctaatgacaggtggagtaaccttggtaagaaagaatagatggttattactaaacgtaacttcagaagacttaggaaaaacatttagtgtaggaactggaaattgcaccacaaacattttagaagcaaaatattggtgtcccgatagtatggaatataactgtccaaacttatcaccacgagaagaacctgatgacatagattgctggtgttatggagtagaaaatgtaagagtggcatatggaaaatgtgatagtgcaggcagatctaggagatcgagacgagcaattgacctacctacacatgaaaaccatggtctaaaaacaagacaagaaaaatggatgacaggaagaatgggtgaaagacaactacagaaaattgaaagatggttcgtaagaaatccattcttcgcagtaacggcattaacaatagcatatttagtagggagtaatatgacacaaagagtagtgatagcgttgctagtattagcagtaggtcctgcatattctgctcactgtataggaattacggatagagacttcatcgaaggagtacatggaggaacatgggttagcgctacgctagaacaagataaatgtgtaactgtgatggcacctgataaaccatcgttagatatcagcttagaaactgtagcaatagacagaccagcagaagtacgaaaagtatgttacaatgctgtattaacacatgtaaaaataaatgacaaatgtccgtccactggagaagcacatttagcagaagaaaatgagggcgataatgcatgtaaacgcacttattcagaccgaggatggggaaatggttgcggattatttggaaaaggctcaatagtagcatgtgcaaaatttacgtgtgcaaaatcaatgtcactatttgaagtcgatcagaccaaaatacaatacgtaataagggcacaattacacgtcggagcaaaacaggaaaattggaatactgatataaaaacattaaaattcgatgcactctcaggatcacaagaagtagaatttataggatatgggaaagcaacgttagaatgccaggttcaaactgccgtcgattttggtaattcatatatagcagagatggaaacagaaagctggatcgtggatcgtcaatgggcacaagatttaacattaccctggcaatcaggatcaggaggtgtttggcgagaaatgcaccatttggtagaatttgaacctccacacgcggcaacaataagagtcctagcacttggtaatcaggaagggagcttaaaaaccgctttaacaggagcaatgagagtgacaaaagacacaaatgataacaatttatataaactccatggaggacatgtatcatgccgcgtaaaactatcggcattaacattgaaaggcacgtcatataaaatctgtacagataaaatgtttttcgtaaagaatccgaccgacacaggtcatgggactgttgtaatgcaagtaaaagtctcaaaaggagctccttgcagaatacctgtaattgtagccgatgatctaacagcagccattaataaaggcatactcgtaacggttaaccctatagctagtactaatgatgatgaagtattaatagaagtaaatcccccttttggagactcatatataatcgttggaagaggagactcaagattaacgtaccaatggcataaggaaggatcaagtataggtaaattattcacacaaacaatgaaaggagtcgaacgactcgcggttatgggagacacagcttgggatttttcatcagccgggggattctttacaagcgtaggtaaaggaatccatacagtgttcggttctgcattccaaggtttgttcggaggattgaattggataaccaaagtaataatgggcgcagtactaatatgggttggcataaacacccgaaacatgacaatgagcatgagtatgatacttgttggtgttataatgatgttcctctcactaggggttggggctgatcaaggatgtgccatcaattttggaaaacgcgaattaaaatgcggagatggtatatttatatttagagatagtgacgattggttaaataaatatagttattatccagaggatcccgtgaaactcgcctctattgtaaaggcttcattcgaagaggggaaatgcggcttaaattccgtagacagcttggaacatgaaatgtggagatctagagcagatgaaataaacgcaattttcgaagaaaatgaggttgatataagcgtagtcgtacaggaccccaaaaacgtttatcaaagaggtacacatccgttctcaagaatcagagatggactacagtatggatggaaaacatgggggaaaaatctggtttttagtccgggacgaaagaacggatccttcataatagatggaaaaagtagaaaagaatgtccatttagcaacagagtctggaatagttttcaaattgaagaatttggaactggcgtatttactacaagagtatatatggatgcagtatttgaatacacaattgactgtgatggatccattctaggagctgcagtaaatggaaagaaaagcgcacatggatcaccaacattttggatgggatcacacgaagtaaatggaacatggatgatacatacactagaagcacttgattataaagagtgtgaatggccgctaacacatactataggtacaagtgtagaggaatcagaaatgttcatgccaaggtcgattggaggtccagtaagctcacacaatcatatacctggatataaagtacaaacaaacggaccttggatgcaagtgcctttagaagtgaaaagagaagcatgtcctggcacatcagtgataatcgacggaaattgtgatgggaggggaaaaagcacacgtagcacaacagactctgggaaagtcattcctgaatggtgttgccgatcatgtactatgccgccagtcagcttccatggaagcgatggatgctggtatccaatggaaattagaccaagaaaaacacatgaatctcatctagtcagatcgtgggtaacagcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 441 - RNA, 10453 nt, synthetic construct
  misc_feature 1..10453: note = mRNA product Design1 comprising derived and/or modified sequence from YFV 17D__NC_002031.1__polyprotein (CDS opt11)
  source 1..10453: mol_type = other RNA
gggagaaagcttaccatgagcggtaggaaggcccagggaaaaaccctgggcgtgaacatggtccggagaggggtgagatccctgagcaacaagatcaagcaaaagacgaaacagatcggcaaccgcccggggcccagccgtggtgtgcagggcttcatcttcttcttcctgttcaacatcttgacggggaagaagatcacagcacacctcaagcgcctatggaagatgctggacccccggcagggccttgcggtgctgcgcaaggtgaagcgggttgtagcctcactgatgcgcgggttgtccagccggaaacgcaggtcccacgacgttctgacagtacagttcctcatcctcggcatgctactgatgaccgggggcgtaacgttagtgcgcaagaataggtggctgttattaaacgtgaccagcgaggacctaggcaagactttttccgtcgggaccggcaactgcacgaccaacatcctggaggccaaatactggtgtccggactcaatggagtacaactgccctaatctctctccacgcgaggagcccgacgacatcgattgttggtgctatggtgttgagaacgttcgagtagcttacggcaagtgcgactcagccggccgctcacgacgcagccggcgggcgatcgacttgcctacccatgagaatcacgggctgaagacgcgccaggagaaatggatgacgggtcggatgggcgagcgccagctccagaagatcgagcggtggttcgtgcgcaaccccttcttcgctgttaccgccctgaccatcgcttaccttgtcggtagtaacatgacccagcgggtggtgatcgcgctactggtccttgccgtgggtcccgcgtacagcgcccactgtatcggaatcacggaccgcgattttatcgagggggtgcatggaggcacctgggtctccgcaaccctcgagcaggacaagtgcgtgactgtcatggcgcccgataagcccagcctagatatctccctagagaccgtggcaatagaccggccggctgaggtacggaaagtctgctataacgctgtcttgacccatgtgaaaatcaacgacaagtgccctagcacgggcgaagcccacctggccgaggagaacgagggagacaacgcctgcaagcggacctacagcgaccgaggatggggcaacggatgtgggctgttcggtaagggctcgatcgtcgcctgcgcgaagttcacgtgcgctaaaagcatgtcactcttcgaagtggaccagaccaaaatacaatatgtgatacgggcccagctgcacgtcggcgccaagcaagaaaattggaacactgacatcaagaccctgaaatttgacgcgctcagcggaagtcaggaagtggaatttatcggctacggtaaggccacgctagagtgccaggtacaaacagccgttgactttgggaacagttatatcgcggagatggagacagagtcctggatcgtggatcgacaatgggcccaggacctaacgctcccttggcagtcgggcagtggaggcgtgtggcgagagatgcaccacctggtcgagtttgagccgccccacgccgcgacgatccgcgtactggcgctcggaaatcaagaggggagcctgaaaaccgcgctgacgggcgccatgagagtgaccaaggacacgaacgacaataacctctacaagttgcacggtggccacgtcagctgccgcgtgaagctgtctgccctgaccctcaagggcacctcctacaaaatctgcaccgacaaaatgttcttcgtaaaaaacccgaccgacacaggccatggcaccgtcgtgatgcaggttaaggtcagtaagggggccccctgccggatccccgttatcgtggcggacgacctgaccgccgccatcaacaagggcatcctggtcacagtgaacccaatcgcctcgaccaacgatgatgaggtgctgatcgaggtcaatccgccattcggggatagctatatcatcgtggggagaggggattcgaggcttacttaccagtggcacaaggaggggagctccattggtaagttgtttacacagacaatgaagggggtggaacgactcgcagtcatgggcgataccgcgtgggacttttcgagtgctggaggctttttcacctctgtcgggaagggcatccacacagtgtttggcagcgccttccaggggttattcggggggctgaactggatcacgaaggttattatgggagccgtgctcatctgggtggggatcaacacgcggaacatgacgatgtccatgtccatgatcttagtaggcgtcataatgatgtttctatcactcggcgtgggggcagaccaaggctgcgccattaattttggcaagcgtgagctgaaatgcggcgacggcatcttcatatttcgcgatagcgacgattggctaaacaagtactcctactatcccgaggaccccgtcaagctcgcgagcatcgtgaaagcctcttttgaggaagggaaatgcggcctgaacagcgtagactcccttgaacacgagatgtggcggagccgcgccgatgagattaacgccatcttcgaggagaacgaagtggatatatccgtcgtagtccaggacccgaagaacgtgtaccagagggggactcacccattcagtaggatacgggacggcctccagtacgggtggaagacttgggggaagaacctggtattttcgcccggacgaaagaacgggagcttcataatcgacgggaaatcccggaaggagtgccccttcagcaatagggtctggaacagctttcagattgaggagttcggcacgggcgttttcaccacccgggtctatatggacgccgtgttcgaatacacgatcgattgcgatgggtcgatcctgggggccgccgtgaatggcaagaagagtgcccacggtagcccgacgttctggatgggcagccacgaggtcaatgggacttggatgatccacaccttagaggcactggactacaaggagtgcgaatggcccctaacccacacgatagggacatccgtggaggagagcgagatgttcatgccccgctccatagggggccctgttagctcccacaaccacatcccaggctacaaagtccagaccaacgggccatggatgcaggtccccctcgaggtgaagcgggaggcatgtccgggcaccagtgtgatcatagatgggaattgtgacggccgcggtaagtccacgcggagcactaccgactctgggaaggtaataccggagtggtgctgccgcagttgtacgatgccacctgtctccttccacggcagcgacggttgttggtacccgatggagatccggccccgcaagacgcacgagtcgcacctcgtccggagctgggtgacagccggcgagattcatgctgtgcccttcgggttagtctccatgatgattgcgatggaggtagtcctccgcaagcggcagggccccaagcagatgctggtagggggggtggtgctattgggcgcgatgctggtcggccaagtgaccctgctcgacctgctgaagctcacagtggccgtcggtctgcacttccacgagatgaataacgggggcgacgccatgtacatggccctgatcgccgcattcagcatccggccgggtctcctgatcggatttggcctccgcacgttgtggagccctcgtgaacgcctggtactgaccctaggtgccgcaatggtggagatcgcgctgggcggggtcatgggcgggctgtggaagtacctcaatgctgtctccctgtgcattttgacgatcaacgctgtggcctcacggaaagcctccaacaccatcctccccctgatggccctgctcacccccgtcacgatggcggaagtgagacttgcggcaatgttcttttgcgccgtcgtaatcataggggttctgcaccagaacttcaaggacaccagcatgcagaagaccataccgcttgtagccctgaccctgacttcctatctcggcctcacccaaccctttctgggtctctgcgcattcctggccacccggatcttcggaaggcgctcaatccccgtaaatgaggccctcgccgccgcgggcctagtgggagtgctggcaggcttagcatttcaggagatggaaaacttcctcgggcccattgccgtgggcgggctattgatgatgctcgtgtccgtggcgggccgcgtcgacggactggagctgaagaagctcggagaggtgagctgggaggaggaggcggagatctcaggttcgtccgcccggtatgacgttgctctcagcgagcaaggggagttcaaacttctatccgaggaaaaggtcccgtgggaccaggtggtgatgaccagcctggctctggtcggcgcggccttacacccgttcgcgcttctgctcgtcctggccgggtggttattccacgtgaggggcgcccggagaagtggcgacgtcctttgggacatcccgacgccaaaaatcatcgaggagtgtgaacacctggaagacgggatctacggcatattccagagcaccttcttgggggcgtcacagcgtggcgtcggggtcgcccagggcggcgtgtttcacaccatgtggcacgtcacacgaggagcctttctcgtccggaacggaaagaagctgatcccgagctgggcctccgtgaaggaggatctggtagcctacggcggctcatggaaacttgaagggcgctgggacggtgaagaagaagtacaactgatcgcggccgtgcccggcaagaacgtggttaacgtccagacgaaacccagtctgttcaaagttcggaacggcggtgagataggagccgtcgcactggactatccgagcggcacaagcggatcccccatcgttaaccgaaacggcgaggtgatcggcctgtacgggaacggaatcctggtcggggacaacagctttgtgtccgctatcagccaaaccgaggtgaaagaggagggcaaggaggagctccaggagatccctacaatgctgaagaaaggcatgacgaccgtcctggatttccaccccggcgccggcaagacccggcgtttcctaccccagattctcgctgaatgcgcaagacggcgcctgcgaacactggttctggcccccacgcgcgtcgtccttagtgagatgaaggaggcgttccacggtctggatgtgaaattccacacccaagccttcagcgcccacggctctgggcgggaagtgatagacgcaatgtgtcacgccaccctcacgtaccgaatgctggagcccactcgtgttgtgaactgggaggtgattatcatggatgaagctcacttcctggaccccgcgtccattgccgcacgcggctgggcggcgcatcgggccagggcgaacgagtcggcgaccattctcatgaccgcgacgccgcccggcacgagcgacgagttcccccattccaatggggagattgaagacgtccagactgacattcccagtgagccgtggaacaccggccacgactggatcctggcggacaaacggcccacggcgtggttcctgccctcaatacgagccgccaacgtcatggcggcgagtctccggaaggccgggaaaagcgtggtcgtgctgaaccgcaagacgttcgagcgggagtacccaaccatcaagcaaaagaaacctgatttcatcctggcaaccgatatcgccgaaatgggcgcgaacctgtgcgtggaacgcgttcttgactgtcgtaccgcgttcaagccagttctggtcgacgaggggcgcaaggtcgccattaaaggccccctccggatttccgcctcttctgcggcgcagagacgagggcgcatcgggcgcaaccccaacagagacggggacagctactactatagcgagcctacgtccgagaacaatgcccatcacgtatgctggctagaggccagcatgctgttggataacatggaggtccgcgggggcatggtcgcacccctatacggggtggaaggcaccaaaacccccgtgtctcccggcgagatgcggctgagagacgatcaaaggaaggtcttcagagagctcgtgagaaactgtgacctgccggtctggctgtcatggcaggtcgccaaggcggggctcaagacaaacgatcgcaagtggtgcttcgagggccccgaggagcacgagatcctgaacgattctggagagactgtgaaatgcagagcccccgggggcgccaaaaagccacttcgcccgcggtggtgcgacgagcgagtctccagcgaccagtcagccctcagcgagttcatcaagtttgctgagggccggcgcggcgcggcggaggtactggtggtgctgtccgaactccccgatttcctcgccaaaaagggcggggaagcaatggacactattagcgtcttcttacactcggaggagggtagccgggcgtaccgtaacgcgctatctatgatgcccgaggcaatgaccatagtgatgttattcatcctcgctggcctgctgaccagcgggatggtaatattcttcatgtccccgaaggggatcagccgtatgtccatggcaatgggcaccatggcgggctgcggctatctgatgtttctcggaggcgtgaaacccacgcatatctcttacgttatgctgatcttctttgtcctgatggttgtggtcatccctgagcccgggcaacaacgaagcatccaggataaccaagtggcctacctcattatcgggatcctgaccctggtctccgccgttgccgccaacgagctcggtatgctggagaaaaccaaggaggaccttttcggaaagaagaacctcatcccgagctcggcgtcaccctggtcctggcctgacctggatctgaagcccggggccgcatggaccgtgtatgtagggatcgtcacgatgttgagtccaatgctgcaccactggatcaaggtggagtatggcaacctctccctctctggcattgcccagtccgccagtgtgctctccttcatggataaagggatccccttcatgaagatgaacatctcagtcatcatgctgctcgtgtctggctggaacagcatcaccgtgatgcccttgctctgcgggatcggatgtgcaatgctccattggtccctgattttgcccgggattaaggcccagcagagcaagctcgcccagcggcgggtatttcatggtgtcgccgaaaaccccgtagtcgacggtaacccaaccgtggacattgaggaggcgcccgaaatgcccgctctttacgagaagaaacttgcactctacctgttgctcgccctgtccctggccagcgtggcgatgtgtagaaccccgttctccctggcggagggcattgtcctggcctctgccgccctgggcccgctaatcgaggggaacacatcccttctctggaacggccctatggcggtcagcatgacgggcgttatgcgtgggaaccactacgccttcgtcggggtgatgtacaatctctggaaaatgaagaccggccgccgtggaagcgcaaacgggaagacgctgggagaggtatggaagcgcgagctcaacctcctggataagcggcaatttgagctgtacaagagaacggacatcgtcgaggtggacagagacactgcccggcggcacctggctgagggcaaggtggacaccggagtcgcggtgtcccgtggcacggccaagttacggtggttccacgaacgcgggtacgtgaagctggagggtcgggtcatcgacctcgggtgcggcagaggcgggtggtgttactacgccgccgcgcagaaggaggtaagcggtgtgaaagggttcacgctgggccgggacggacacgagaagcccatgaacgtacagtcactgggatggaacatcatcaccttcaaggacaagacagacatccaccgcctcgagccggttaaatgtgacaccctgctttgcgacattggtgagtcgtccagctcgagcgtgacggagggggagcggaccgtacgcgtgctcgacaccgtggaaaagtggctcgcatgcggcgtcgacaacttttgcgtgaaggtactggccccatatatgcccgacgtcctcgaaaagctcgagctgctgcagcgacgtttcggtggcaccgttatccggaacccactctcgcgcaacagtacgcacgagatgtactacgtgtcgggagcccgcagcaacgtcaccttcaccgtgaaccaaacctcccggttgctgatgcgtagaatgcgccggcccacgggcaaggtcaccctggaggccgacgtcattctgcctatcggcacccggtcggtagagaccgacaaggggccgttagataaggaggcgatcgaagagagggtggagcgcatcaaatccgagtacatgacgagctggttctacgacaacgacaacccttatagaacctggcattattgcggcagctacgtgaccaaaacctccgggagcgccgcttccatggtcaacggcgtcattaaaatcctcacctacccgtgggaccgcatagaggaggtgactcggatggctatgacagacactaccccattcggccaacagcgggtgtttaaagaaaaggtcgacacgcgggccaaggatccgcccgcgggaacacgcaagatcatgaaggtggtgaaccgatggcttttccgccacctggcccgcgagaagaacccccgcctctgcaccaaggaggagttcattgccaaagtccggagccacgccgcaatcggcgcgtacctggaggagcaggagcaatggaagaccgccaacgaggccgtgcaggaccccaagttctgggagctggttgacgaagaacgcaagttacaccagcaggggcgctgccggacgtgcgtttacaatatgatgggcaaacgagaaaagaagttgtccgagtttgggaaagctaaaggcagccgagccatctggtacatgtggcttggcgcgcgctacctcgagttcgaggcccttgggttcctgaacgaggaccactgggcctcgcgggagaactctggcggaggcgtggaagggatcggcctacaatacctcggctacgtgatcagagacttggccgcgatggacgggggcgggttctacgccgacgacactgctggctgggacacccgcatcacagaggccgacctcgacgacgagcaggagatcctgaactacatgagcccccaccacaagaagctggcccaggcggtcatggaaatgacgtataagaacaaggtagtgaaggtcctccgccccgcccccgggggcaaagcctacatggacgtgatctcgaggcgcgaccaaaggggctccggtcaggtggtcacctacgccttgaacactatcaccaacctaaaggtgcagttaatacgcatggctgaggcggagatggtgatccaccaccagcacgtccaggactgcgacgagagcgtgctgacgcgtctggaagcctggctaacagagcacgggtgtgatcgcctgaagcgtatggcagtttcaggggacgactgtgtggtgcgccccatcgacgatcggttcggactggcgctctcccacctgaacgccatgtcaaaagtgcgcaaggacatcagcgagtggcagccctccaagggttggaacgactgggagaatgtcccgttctgtagccaccactttcacgaactccagcttaaggacggccggcgcatcgtggtgccctgccgggagcaagatgagctgataggcagggggcgtgtttcccccggtaacgggtggatgatcaaggagaccgcgtgcttgagcaaggcctatgcgaacatgtggagtctcatgtactttcacaagcgggacatgcgcctactgtccctcgccgtttcttccgcggtacccacgagctgggtcccacagggccggacaacttggtccatccacgggaagggggagtggatgaccactgaggacatgctggaggtgtggaaccgagtgtggatcacgaacaacccccatatgcaggacaagacgatggtcaagaagtggcgggacgtgccgtacctaacaaagagacaggacaaactgtgtggaagccttatcggcatgaccaaccgggccacctgggcatctcacattcacttagtaatccaccgaatacggaccctaatcggccaggagaagtataccgactatttgaccgtaatggatcgctactctgtagacgccgacctgcagctcggtgagttgatctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 442 - RNA, 2554 nt, synthetic construct
  misc_feature 1..2554: note = mRNA product Design1 comprising derived and/or modified sequence from YFV 17D__NC_002031.1__C-prME (CDS opt11)
  source 1..2554: mol_type = other RNA
gggagaaagcttaccatgtcgggcaggaaagcacaaggcaaaacgctaggagtaaatatggtcagacggggcgtacgcagcctatcaaacaagataaagcagaaaaccaaacaaatcggaaaccgacccggaccaagccggggcgtccaaggattcatcttcttctttctattcaacatactaaccggaaagaaaatcacagcgcacttaaaacgcctatggaaaatgctagacccccgccaaggactcgccgtgctaaggaaagtgaaacgagtcgtagcctccctgatgcgcggactgagcagcaggaaaagacgaagccacgacgtcctgacagtacaattccttattctcggaatgctactcatgacgggcggagtcaccctagtgaggaaaaaccgctggctcctgctcaacgtaacaagcgaagatctgggaaaaacattcagcgtcgggacaggaaactgcaccaccaacatcctagaagcaaaatactggtgccccgacagcatggaatacaactgccccaatctaagcccaagagaggaacccgacgacatagactgttggtgttacggggtcgaaaatgtcagagtcgcgtacggcaagtgcgactcggcaggcagaagccgaaggagtcgacgcgcaatcgacttgccgacccatgaaaaccacggcttaaaaacccgacaagaaaagtggatgacgggacgcatgggagagcgccaactccagaaaatagaacgatggttcgtgagaaacccgttcttcgcggtaaccgcactaacgatagcatacctcgtcgggtccaacatgacgcaaagggtagtgattgcactcctagtgctagccgtgggcccagcatactccgcacactgcataggcatcacagacagagacttcatcgagggagtgcacggaggcacatgggtaagcgcaaccctcgagcaagacaaatgcgtaacagtcatggcacccgacaaacccagcctagacataagcctcgaaacagtcgccatcgaccgcccagcagaagtacgcaaagtctgctacaacgcagtacttacgcacgtaaaaatcaacgacaaatgccctagcacaggcgaagcacacctcgcagaagaaaacgagggagacaacgcgtgcaagagaacgtactcagaccgaggctggggaaacggatgcggactattcgggaaaggaagcatcgtcgcatgcgcaaaattcacgtgcgcgaaaagcatgagcctctttgaagtagaccagaccaagattcaatacgtcataagagcgcaactgcacgtaggagcgaaacaggagaactggaacaccgacataaaaacactaaagttcgacgcactctcagggagtcaagaagtcgagttcataggatacggaaaggcaacactcgaatgccaagtccaaacagcagttgacttcgggaactcatacatagcggagatggaaacagagagctggatcgtcgacagacagtgggcccaggacttaacactaccctggcagagcggctcgggaggcgtctggcgcgagatgcaccacctggtcgagttcgaaccaccgcacgcagccacaatacgagtattggccctaggaaatcaagaaggctcgctcaaaacggcactaacaggagcaatgagggtcacgaaagacacaaacgacaataacttgtacaaactccatggcgggcacgtgtcatgccgcgtaaaactgagcgcgctcaccctaaaaggaaccagctacaaaatatgcacagacaagatgttctttgtcaaaaaccccactgacacaggacacggaacggtagtaatgcaagtcaaagtaagcaagggcgcaccatgccggataccggtcatagtcgcagacgacctaacagcggcaatcaataaaggtatactggtgacagtcaacccaatagccagcaccaacgacgacgaagtcctaatagaagtaaacccacccttcggcgactcctacatcatagtagggaggggagactcgcgattgacctaccaatggcacaaagaaggaagctcaataggcaagttgttcacacaaacgatgaagggagtagagaggctagccgtcatgggagatacagcatgggacttcagcagcgcaggcgggttcttcacatcagtgggtaaggggatacatacggtattcggcagcgccttccagggattgttcggaggcctaaactggatcaccaaagtcatcatgggggcagtcctaatatgggttggaataaacacacggaacatgacaatgagcatgagcatgatactcgtcggggtgataatgatgttcctgagcctcggagtaggtgcttgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 443 - RNA, 3610 nt, synthetic construct
  misc_feature 1..3610: note = mRNA product Design1 comprising derived and/or modified sequence from YFV 17D__NC_002031.1__C-prME-NS1 (CDS opt11)
  source 1..3610: mol_type = other RNA
gggagaaagcttaccatgtcgggacgcaaagcgcaaggcaaaacgctaggagtgaacatggtccgacgcggagtaaggagcctgagcaacaaaatcaaacagaaaacaaaacaaataggcaatcgcccgggcccgagcaggggcgtgcagggattcatattcttcttcttattcaacatcctcacaggaaagaaaataacggcccatctaaaacgactctggaaaatgttagacccaagacaaggcctcgctgtactcagaaaagtaaaacgcgtcgtcgcctcccttatgcggggactatcaagccgcaaaagacgatcacacgatgtactcacggtgcagttcctcatacttggaatgttgctaatgaccggaggagtaaccttagtacgaaagaaccgatggctgttactcaacgtcacgagcgaagacctaggcaaaaccttctcagttggaacgggtaattgcacgacaaacatactcgaagccaaatattggtgcccagactccatggaatataactgccccaatctaagcccacgagaggaacccgacgacatagattgctggtgctatggagtagaaaacgtacgcgtcgcatacggaaaatgcgactcagcgggccgctcacggcggtcacggagagcaatagacctacccacacatgagaaccacgggctaaaaactcgtcaggaaaaatggatgaccggccgcatgggcgagcgacaactacagaaaatagagaggtggttcgtaagaaacccatttttcgcggtcacagcactcacaatcgcatacctagtaggaagcaatatgacgcaaagggttgtaatagccctgctagtcctggccgtagggccggcatactccgcccactgcatcggtataacggatagggacttcatagaaggcgtacacggagggacatgggtaagcgcaacactagagcaggacaaatgcgtaaccgtcatggcacccgacaaaccgagcttggatatctcactcgaaaccgtcgcgatcgacagacccgcagaggtcagaaaagtatgctacaacgccgtcctgactcacgtaaaaatcaacgacaaatgccccagcactggagaggcacacctggccgaagagaacgaaggcgacaacgcatgcaaacgcacgtacagcgacagagggtggggcaacggctgcggcctgttcggcaaggggagcatagtagcctgcgcaaaattcacatgcgccaagagcatgtcgctgttcgaggtagaccaaaccaagatccaatacgtaatcagagcacagctacacgtgggtgcaaaacaggagaactggaacaccgacatcaaaaccctcaagttcgacgcgctcagtggctcacaagaagtagagttcataggatacggaaaagcaaccctggaatgccaagtccaaacagcagtagacttcgggaactcgtacatagccgagatggagaccgaaagctggatagtagatcgacaatgggcacaggacctcaccctaccgtggcaaagtgggagcggaggggtctggcgagaaatgcaccacctagtggaatttgagccgccacacgcagccacgatacgcgtgcttgcactgggcaaccaagaagggtctctaaaaaccgcccttacgggcgctatgagagtcacaaaagacacgaacgacaataacctgtacaagctacatgggggacatgtcagctgccgcgtcaaactcagcgcactcacgctcaaaggcacgagctacaagatatgcaccgacaaaatgttcttcgtcaaaaacccgacagacactgggcacgggacggtagtgatgcaagtcaaagtatcaaagggcgcaccatgccgcattccagttatagttgccgacgacctaacagccgcaatcaacaaaggcatcctagtcacggtaaacccgatagcatccaccaacgacgacgaagtactgatagaagtcaacccgccattcggagactcatacataatagtcggacggggcgacagccgcctaacctaccaatggcacaaggaaggcagctccatcggaaaattgttcacgcaaacaatgaaaggcgtcgaacgcctagcggtcatgggcgacacagcgtgggacttttccagcgcagggggcttcttcacgtccgtagggaaaggcattcacacggtgttcggaagcgcgttccaaggactgttcggcgggttgaactggatcacgaaagtgatcatgggtgcagtacttatatgggtgggaataaacacacgcaacatgacgatgtcaatgtcaatgatcctagtcggagtcataatgatgttcctcagcctaggcgtcggagcagaccagggctgcgccataaacttcggcaagcgcgaactaaagtgcggcgacggcatattcatcttccgcgactctgatgactggctgaacaaatacagctactacccagaggacccggtcaaattggcctccatagtaaaagctagctttgaggaagggaagtgcgggctcaacagcgtagacagcctcgaacacgagatgtggcgcagtcgtgcagatgaaataaacgcgatattcgaagaaaacgaagtcgacataagcgtggtagtacaggatccgaaaaacgtttaccaacgcggaacccacccattcagcagaatacgagacgggctgcaatacgggtggaaaacgtggggcaagaacctggtattcagccccggccgcaaaaacggcagcttcataatagacggcaaaagcagaaaagaatgccccttcagcaaccgtgtatggaatagcttccaaatcgaagagttcggaaccggtgtattcaccacccgagtctacatggacgcagtcttcgaatacacaatcgactgcgacggcagcatcctgggcgcagcagtaaatgggaagaaatcagcccacggtagcccaacattctggatgggcagccacgaagtaaacggaacgtggatgatccacacactggaagccctagactacaaagaatgcgagtggccattgacacacaccatcgggactagcgtcgaagagtcagagatgttcatgccgcgaagcatagggggcccggtatcaagccacaaccatatcccgggatacaaagtgcaaacgaacggcccgtggatgcaggtacccctcgaagtaaaacgagaagcctgcccaggcaccagcgtcataatagacggcaactgcgatggccggggaaaaagcacccgaagcaccacagactcgggaaaagtcatcccggaatggtgctgcagaagctgcacgatgccacctgtatcgtttcacggaagcgacgggtgctggtacccaatggaaatccgaccaaggaaaacacatgagagccatctagtccgatcctgggtcacagcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 444 - RNA, 2311 nt, synthetic construct
  misc_feature 1..2311: note = mRNA product Design1 comprising derived and/or modified sequence from YFV 17D__NC_002031.1__X-SS-prME-XX (CDS opt11)
  source 1..2311: mol_type = other RNA
gggagaaagcttaccatgcggggactaagcagcagaaaaagacgcagccacgatgtgctcaccgtgcaattcctcatactggggatgctcctaatgaccggaggcgtgaccctagtaaggaaaaacagatggctactactaaacgtaacctcagaagatctaggaaagacattttcagtcggcacaggcaactgcacaaccaacatactagaagcaaaatattggtgcccagacagcatggaatacaactgtcccaacctcagcccaagagaggaaccagacgacatagactgctggtgttacggagtagaaaacgtaagagtggcatacggcaaatgcgacagcgcaggcaggagccgaagatcccgcagagccatcgacttgcccacgcacgaaaaccacggcctcaaaacacgacaagaaaaatggatgacagggcgaatgggagaacgacagctccagaaaatagaacgatggttcgtccggaacccgttcttcgcagtaacggcactaacaatcgcatacctcgtaggcagcaacatgacacaaagagtggtcatcgcgctactcgtactagcagtggggcccgcatacagtgcacactgcataggaatcacagaccgtgacttcatcgaaggcgtacacggaggaacgtgggtaagcgcgacactggaacaagacaaatgcgtgacagtaatggcaccagacaaaccaagcctagacatatccctagaaacggtcgccatcgaccgtcccgcagaagtacgaaaggtatgctataatgcagtcctcacacacgtcaaaataaacgacaaatgccccagcacgggcgaagcacacctcgccgaagaaaacgaaggggataacgcgtgcaaacgcacctactccgacaggggatggggcaacggatgcggactgttcggaaaaggatccatagtcgcatgcgcaaaatttacctgcgcaaaaagcatgagcttgttcgaggtagaccaaacgaagatccaatacgtaatccgagctcaactacacgttggggccaagcaagagaactggaatacggacatcaaaacactaaaattcgacgcactctccggctcacaagaagtcgagttcatcggctacggcaaagcaacactagaatgccaagtacaaacagcggtggacttcggcaacagctacatagcagaaatggaaacagaaagctggatagtagaccgacaatgggcacaagacctaactctgccatggcaaagcggctcaggaggagtgtggagagagatgcaccacctggtagagttcgaacccccacacgcagcaacaataagggtactggcactaggcaaccaagaaggcagcctaaaaaccgcactcacaggagccatgcgcgtgacgaaggacaccaacgacaacaacctctacaaactccacggagggcacgtatcctgccgcgtaaaactatcagcactaacgctaaaaggaacaagctacaaaatatgcacagacaaaatgttcttcgtcaaaaaccccacagacacaggccacggcacagtcgtaatgcaagtgaaggtcagcaagggggccccctgccgaatcccagtcatagtggcagacgacctcacggccgccatcaacaaagggatcctggtaacagtgaacccaatagcatcgaccaacgacgacgaagtcctcatagaagtgaatcccccgttcggcgacagctacatcatcgtaggacgcggcgactcccgactgacgtaccaatggcataaagaaggcagcagcattggaaaactattcacccaaaccatgaagggcgtcgaaagactcgcggtgatgggagacaccgcatgggacttctcgagcgcaggcggcttcttcacaagcgtaggaaaagggattcacacagtattcggatccgcattccaaggcctcttcgggggactaaactggataacgaaagtaataatgggagcagttctcatatgggtaggaatcaacacacgaaacatgacaatgtccatgtcaatgatactcgtaggcgtaatcatgatgtttctgtcactcggagtgggagcagaccaaggttgcgccataaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 445 - RNA, 1801 nt, synthetic construct
  misc_feature 1..1801: note = mRNA product Design1 comprising derived and/or modified sequence from YFV 17D__NC_002031.1__X-SS-E (CDS opt11)
  source 1..1801: mol_type = other RNA
gggagaaagcttaccatgagaggactatcgagcaggaaacgacgatcgcacgacgtactgacagtgcaattcctcatactaggaatgctgctaatgacagggggcgtgacactggttgcacactgcatagggataacagacagggactttatcgagggcgtacacggaggcacgtgggtcagcgcaacactagaacaggacaagtgcgtgaccgtgatggcccccgacaaacccagcctggacataagcctagaaacagtcgcgatcgaccgcccggccgaagtcaggaaagtgtgttacaacgcggtactgacccacgtcaaaataaacgacaaatgcccaagcacgggcgaagcccacctagcagaagagaacgagggcgacaacgcatgcaaacgcacctactcggacagaggatggggaaacggctgcggcctattcgggaaagggagcatagtcgcatgtgcgaaatttacctgcgccaagagcatgtccctgttcgaagtagaccaaacaaaaatacaatacgtaataagagctcaactgcacgtcggagcgaaacaggaaaactggaacaccgacatcaagaccctgaaattcgacgcgttatcaggctcacaagaggtcgagtttataggctatggcaaggccacacttgaatgccaggtccagaccgcggtagacttcgggaactcatacatagcagagatggaaactgaaagctggatcgtagaccgacaatgggcacaggacctgaccctgccgtggcagtcaggctcgggaggagtctggcgagaaatgcatcacctggtagaatttgagcccccgcacgcggcaacaatcagggtcttagccttgggcaaccaagagggctcgctcaaaacagcgctcacaggcgcgatgcgggtcacgaaagacacaaacgacaacaacctgtacaaactacacggcggccacgtgtcatgccgcgtgaaactaagcgcgctcacgctcaagggaacaagctataaaatatgcacggacaagatgtttttcgtcaaaaacccaacagacacaggccacggcacggtagtgatgcaggtcaaggtctcaaaaggggccccgtgcagaataccagtgatagtcgcggacgacctcacagccgcgatcaacaaagggatcctggtcacagtaaaccccatagcctcaacgaacgacgacgaggtactcatagaagtgaacccgcccttcggagacagctacatcatagtaggacgaggggactcgcgcctgacctaccaatggcacaaggaagggagctcgatagggaaattattcacgcaaacaatgaaaggagtagaacggctcgccgttatgggagacaccgcgtgggacttctccagcgccggcggattctttaccagcgtagggaaagggatccacaccgtattcggaagcgcattccaaggcctgttcgggggcctcaactggatcacaaaagtgatcatgggtgcagtactgatttgggtcggaatcaacaccagaaacatgaccatgtccatgagcatgatactcgtaggggtcataatgatgttcctgagcctaggcgtgggcgcgtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 446 - RNA, 1831 nt, synthetic construct
  misc_feature 1..1831: note = mRNA product Design1 comprising derived and/or modified sequence from YFV 17D__NC_002031.1__X-SS-E-XX (CDS opt11)
  source 1..1831: mol_type = other RNA
gggagaaagcttaccatgcgcggactctcgtcaagaaagagacgctcgcacgacgtcctcaccgtacaattcctaatcctgggaatgctcctcatgacaggaggcgtaacgctcgtcgcccactgcatcgggatcacagaccgggacttcatcgaaggcgtacacggaggcacatgggtaagcgccaccctagaacaagacaaatgcgtaaccgtaatggcgccagacaaaccgagcctcgacataagcctagaaacggtcgcgatagaccgtccggcagaagtcaggaaagtatgctacaacgcggtactaacccacgtcaaaatcaacgacaaatgcccgagcactggggaggcacacctcgcagaagagaacgaaggcgacaacgcgtgcaaacgcacatactcggaccgaggctggggaaacggatgcggcctgttcgggaaaggcagcatagtcgcgtgcgccaaatttacctgcgccaaaagtatgagcctattcgaggtagaccaaaccaaaatccaatacgtaataagagcacaactgcacgtaggcgcaaaacaagaaaactggaacaccgacatcaaaaccctaaaattcgacgccctatcgggatcgcaagaagtcgagttcattggctacggcaaagctacgctagaatgccaagtacaaaccgcggtagacttcgggaactcatacatagccgaaatggaaaccgagagctggatcgtcgataggcaatgggcccaagacctgaccctaccctggcaatcggggtcgggcggggtctggcgcgagatgcatcacttagtcgagttcgaaccaccgcacgcggccaccatcagggtattagccctcggaaatcaagaaggatcactcaaaaccgcgctaacaggcgccatgcgggtaacaaaagacaccaacgacaataacctatacaaacttcacggcggacacgtaagctgccgcgtaaaactcagcgcactgaccctaaagggcacgagctacaaaatatgcacggacaaaatgttcttcgtaaagaacccaacagacaccggacacggaacggtagtaatgcaagtaaaggtatccaaaggagcaccatgcagaatcccagtcatagtcgccgacgacctcacagccgcaataaacaaagggatcctagtcactgtcaaccccatagcctccaccaacgacgacgaagtactaatagaagtcaacccacccttcggcgacagctacataatagtaggacgtggggactcccgcctcacctaccaatggcacaaagaaggaagctccatagggaagctgttcacccaaacaatgaaaggagtcgaaagactagccgtaatgggcgacaccgcatgggacttctcaagcgcgggcgggttcttcacctctgtaggcaagggcatccacaccgtgttcggaagcgcattccagggcctattcggaggcctgaactggatcacgaaagtaattatgggagcagtactaatctgggtcgggataaatacaagaaacatgactatgagtatgagcatgatcctcgtcggagtaataatgatgttcctaagcctcggtgtgggcgcagaccaaggctgcgccataaacttcggcaaatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 447 - RNA, 2248 nt, synthetic construct
  misc_feature 1..2248: note = mRNA product Design1 comprising derived and/or modified sequence from YFV 17D__NC_002031.1__SS-prME (CDS opt11)
  source 1..2248: mol_type = other RNA
gggagaaagcttaccatggacgtccttacggtacaattcctaatactaggaatgcttctcatgaccgggggcgtcaccctagtccggaaaaacagatggctactgctaaatgttacaagcgaagaccttggcaagacattcagcgtaggcacgggcaactgtacaaccaacatactagaagcgaaatactggtgcccagactccatggagtacaactgccccaacctaagcccacgggaagaacccgacgacatagactgctggtgttacggggtcgaaaacgtccgcgtcgcatacgggaaatgcgatagcgcaggccgcagtagacgctcccgccgcgccatagacctaccaacgcacgagaaccacggcctcaaaactcgccaagaaaaatggatgacagggcgaatgggtgaacgccaactacagaagatcgaaaggtggttcgtcaggaacccattcttcgcagtgaccgcactaacgatagcctacctagtgggatcaaacatgacgcaacgagtcgtgatcgcactcctagtactggccgtaggaccggcctactccgcgcactgcatcggcataacggatagggacttcattgaaggagtacatggcggcacgtgggtcagcgcgacactcgaacaagacaaatgcgtaaccgtgatggcacccgacaaaccgagtcttgacataagcctggaaacggtagcgatagatcgtccagccgaagtaagaaaagtatgctacaacgcagtcctaacacacgtaaaaataaacgacaaatgcccaagcacaggggaagcccacctcgcagaagagaacgaaggcgacaacgcatgcaaacgcacatactccgacaggggatgggggaatggctgcggactattcgggaaaggaagcatcgtcgcgtgcgccaaattcacatgcgccaagagcatgagcctgttcgaagtcgaccaaacaaaaatccaatacgtaatacgcgcgcaactgcacgtaggagcgaaacaggaaaactggaacacggacattaaaaccctcaaattcgacgcgctctcaggatcacaagaagtcgagttcatcggctacggcaaggcaacgctcgaatgccaagtacaaacagcagtagacttcggaaacagctacattgccgagatggaaaccgagagctggatagtcgacagacaatgggcccaagacctaaccctgccatggcaatcaggctccgggggcgtctggcgagagatgcaccacctagtagagttcgaaccaccccacgccgccacgatcagagtactggccctgggcaaccaagaaggctcactcaagacggcgctcacaggagcaatgagggtcacgaaagacaccaacgacaacaacctctacaaactacacggagggcacgtgagctgccgggtaaaactgagcgcactcactctgaagggaacaagctacaagatatgcaccgacaaaatgttcttcgtgaaaaacccaaccgacactggacacggcacggtcgttatgcaagtcaaggtatcaaaaggagccccatgcagaatcccagtaatagtagcggacgacctaacagccgccataaacaaaggaatcctagtcacggtaaatccgatagcatcgaccaacgacgacgaagtactaatagaagtgaacccaccattcggcgacagctacataatagtcgggagaggcgactcgcgactaacctaccaatggcacaaggaagggagctctatcgggaaactattcacccaaacgatgaagggcgtagaaaggctcgcagtcatgggcgacaccgcatgggacttctccagcgcgggaggcttctttacttcagtgggaaaagggatacacaccgtcttcggcagcgcattccagggcctattcggcgggttaaactggatcacgaaagtgataatgggggcagttctcatctgggtcggaataaacacacgtaacatgaccatgagcatgagcatgatcctagtcggggtcataatgatgttcttgagcttgggagtaggtgcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 448 - RNA, 3304 nt, synthetic construct
  misc_feature 1..3304: note = mRNA product Design1 comprising derived and/or modified sequence from YFV 17D__NC_002031.1__SS-prME-NS1 (CDS opt11)
  source 1..3304: mol_type = other RNA
gggagaaagcttaccatggacgtactgaccgtacaattcctcatcctcggcatgctactcatgaccgggggcgtaactttggtccgcaaaaatcggtggctcctcctaaacgtcacatcagaagacctcgggaaaacgttcagcgtaggaacaggaaattgcacgaccaacatcctcgaagcgaaatactggtgcccagacagcatggaatacaactgtcccaacctcagcccccgggaagaacccgacgacatcgactgctggtgttacggagtcgagaacgtccgcgtggcctacggcaaatgcgactccgcaggccggagtagaagatcacgtcgcgcgatcgacctgcccacacatgaaaaccacggattaaaaacccgacaggaaaagtggatgaccgggagaatgggagaaagacaactccagaaaatagaaagatggttcgtccgaaacccgttctttgcagtaaccgccctcacaatagcatacctcgtcgggagcaacatgacccaacgggtcgtgatcgccctcctagtactagcggtcggaccagcgtacagcgcacactgcataggcataacagatcgtgacttcatagagggagtacatggtgggacatgggtgtccgcaaccttagaacaagacaaatgcgtcaccgtcatggcgcccgacaagcccagcttagacatatccctggaaacggtggccatcgacagaccggccgaagtgcgcaaagtatgctacaacgcggtactcacccacgtcaaaataaacgacaaatgcccaagcacaggagaggcacacctggccgaagagaacgaaggcgacaacgcgtgcaagcgaacatactcagacagaggatgggggaacggctgcggcctattcggaaagggaagcatagtagcgtgtgcaaaatttacctgcgccaagagcatgagtttgttcgaggtcgaccaaacaaaaatccaatacgtgatccgagcacaactgcacgtaggcgcaaaacaagaaaactggaacaccgacataaagacactgaaattcgacgcactgagtggctctcaggaggtcgagttcataggctacgggaaggcaacactcgaatgccaagtccaaaccgcggtagatttcgggaacagctacatcgcagaaatggaaacagaaagctggatcgtggaccgccaatgggcccaagacctaaccctaccctggcagtcaggcagtggcggcgtctggcgagaaatgcaccatctcgtggagttcgaaccaccccacgccgccacgatcagagtcctcgccctcggtaaccaggagggatccctaaagacagcactgaccggagcgatgcgtgtaacaaaagacaccaatgataacaacctatacaaactgcacggcgggcacgtgagttgccgcgtgaaactaagcgcgcttacactcaaaggcacaagctacaaaatatgcacggacaaaatgttcttcgtcaagaacccaaccgacacgggccatggaaccgtcgtaatgcaagtcaaggtatcgaaaggcgcaccgtgcagaataccagtgatagtggcggatgacctcaccgcagcaatcaacaaaggcatcctggtcacagtcaacccaatagcctccacgaacgacgacgaagtcctgattgaggtaaacccaccgttcggagacagctacatcatagtcggacgcggagacagtcgcttaacataccagtggcacaaagaagggagctcaataggaaagttattcacgcaaactatgaaaggagtagaacgactagcggtaatgggcgacacagcgtgggacttctcaagcgcgggtggctttttcacatcggtagggaaaggcatccatacagtattcggaagcgccttccagggtttattcggcgggctgaattggatcacaaaagtaatcatgggcgcggtcttaatctgggtgggcatcaacacccgaaacatgacaatgagcatgagcatgatcctagtcggcgtcatcatgatgttcctctccctgggcgtgggcgcagaccagggatgcgccatcaacttcggaaagcgcgagctaaagtgcggcgacggcatcttcatattcagggatagcgacgactggctaaacaaatactcctattatccagaagaccccgtcaaactagcctcaatcgtgaaagcgagcttcgaggaaggcaaatgcgggctaaactcagtagactcactcgaacatgaaatgtggagatcaagagcagacgagatcaacgcaatcttcgaagaaaacgaagtcgacatcagcgtggtcgtccaagaccccaaaaacgtgtaccaacgcggaacccaccccttcagccggatccgcgacggactacaatacgggtggaaaacatggggcaagaacctcgttttcagccccggacggaagaacggctccttcatcatcgacggaaaaagcagaaaagagtgcccattctcaaaccgagtctggaactctttccaaatcgaagagttcgggacaggcgtcttcacgacccgcgtatacatggacgccgtgttcgagtacacaatagactgcgacggatcaatattaggagcagccgtgaacggaaagaaaagcgcacacggatcacctacattctggatgggctcacacgaggtcaacggcacatggatgatacacaccctagaggccctcgactacaaagaatgcgagtggcctctaacccataccatcggaacaagcgtggaagagtccgagatgtttatgccaaggtcgatcgggggcccagtgtccagccataaccacataccagggtacaaagtgcaaacaaacggtccgtggatgcaggtaccactagaggtcaagcgggaagcatgccccgggacatcagtcataatcgacggcaactgcgatggcagaggcaaaagcacacgttccaccacggactcaggaaaagtaataccagaatggtgctgcagaagttgcacaatgcccccagtaagtttccatggatccgacggatgctggtacccaatggaaatcagacctcggaaaacgcacgagagccatctggtcagaagctgggtcaccgcatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 449 - RNA, 2554 nt, synthetic construct; identical to SEQ ID NO: 402
  misc_feature 1..2554: note = mRNA product Design1 comprising derived and/or modified sequence from YFV 17D__NC_002031.1__C-prME (CDS opt16)
  source 1..2554: mol_type = other RNA

SEQ ID NO: 450 - RNA, 3610 nt, synthetic construct; identical to SEQ ID NO: 403
  misc_feature 1..3610: note = mRNA product Design1 comprising derived and/or modified sequence from YFV 17D__NC_002031.1__C-prME-NS1 (CDS opt16)
  source 1..3610: mol_type = other RNA

SEQ ID NO: 451 - RNA, 2311 nt, synthetic construct; identical to SEQ ID NO: 404
  misc_feature 1..2311: note = mRNA product Design1 comprising derived and/or modified sequence from YFV 17D__NC_002031.1__X-SS-prME-XX (CDS opt16)
  source 1..2311: mol_type = other RNA

SEQ ID NO: 452 - RNA, 1801 nt, synthetic construct; identical to SEQ ID NO: 405
  misc_feature 1..1801: note = mRNA product Design1 comprising derived and/or modified sequence from YFV 17D__NC_002031.1__X-SS-E (CDS opt16)
  source 1..1801: mol_type = other RNA

SEQ ID NO: 453 - RNA, 1831 nt, synthetic construct; identical to SEQ ID NO: 406
  misc_feature 1..1831: note = mRNA product Design1 comprising derived and/or modified sequence from YFV 17D__NC_002031.1__X-SS-E-XX (CDS opt16)
  source 1..1831: mol_type = other RNA

SEQ ID NO: 454 - RNA, 2248 nt, synthetic construct; identical to SEQ ID NO: 407
  misc_feature 1..2248: note = mRNA product Design1 comprising derived and/or modified sequence from YFV 17D__NC_002031.1__SS-prME (CDS opt16)
  source 1..2248: mol_type = other RNA

SEQ ID NO: 455 - RNA, 3304 nt, synthetic construct; identical to SEQ ID NO: 408
  misc_feature 1..3304: note = mRNA product Design1 comprising derived and/or modified sequence from YFV 17D__NC_002031.1__SS-prME-NS1 (CDS opt16)
  source 1..3304: mol_type = other RNA

SEQ ID NO: 456 - RNA, 2311 nt, synthetic construct
  misc_feature 1..2311: note = mRNA product Design1 comprising derived and/or modified sequence from YFV 17D__NC_002031.1__X-SS-prME-XX (CDS opt17) R2401
  source 1..2311: mol_type = other RNA
gggagaaagcttaccatgcggggcctctcctcccggaagcggcggtcccacgacgtcctcaccgtccagttcctcatcctcggcatgctcctcatgaccggcggcgtcaccctcgtccggaagaaccggtggctcctcctcaacgtcacctccgaggacctcggcaagaccttctccgtcggcaccggcaactgcaccaccaacatcctcgaggccaagtactggtgccccgactccatggagtacaactgccccaacctctccccccgggaggagcccgacgacatcgactgctggtgctacggcgtcgagaacgtccgggtcgcctacggcaagtgcgactccgccggccggtcccggcggtcccggcgggccatcgacctccccacccacgagaaccacggcctcaagacccggcaggagaagtggatgaccggccggatgggcgagcggcagctccagaagatcgagcggtggttcgtccggaaccccttcttcgccgtcaccgccctcaccatcgcctacctcgtcggctccaacatgacccagcgggtcgtcatcgccctcctcgtcctcgccgtcggccccgcctactccgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgccgaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 457 - RNA, 1801 nt, synthetic construct
  misc_feature 1..1801: note = mRNA product Design1 comprising derived and/or modified sequence from YFV 17D__NC_002031.1__X-SS-E (CDS opt17)
  source 1..1801: mol_type = other RNA
gggagaaagcttaccatgcggggcctctcctcccggaagcggcggtcccacgacgtcctcaccgtccagttcctcatcctcggcatgctcctcatgaccggcggcgtcaccctcgtcgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgcctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 458 - RNA, 1831 nt, synthetic construct
  misc_feature 1..1831: note = mRNA product Design1 comprising derived and/or modified sequence from YFV 17D__NC_002031.1__X-SS-E-XX (CDS opt17)
  source 1..1831: mol_type = other RNA
gggagaaagcttaccatgcggggcctctcctcccggaagcggcggtcccacgacgtcctcaccgtccagttcctcatcctcggcatgctcctcatgaccggcggcgtcaccctcgtcgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgccgaccagggctgcgccatcaacttcggcaagtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 459 - RNA, 10618 nt, synthetic construct
  misc_feature 1..10618: note = mRNA product Design2 comprising derived and/or modified sequence from YFV 17D__NC_002031.1__polyprotein (CDS wt)
  source 1..10618: mol_type = other RNA
ggggcgctgcctacggaggtggcagccatctccttctcggcatcaagcttaccatgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagcttgcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccagaattcgggatggtctgcagtatggttggaagacttggggtaagaaccttgtgttctccccagggaggaagaatggaagcttcatcatagatggaaagtccaggaaagaatgcccgttttcaaaccgggtctggaattctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcttgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagctggagaaatacatgctgtcccttttggtttggtgagcatgatgatagcaatggaagtggtcctaaggaaaagacagggaccaaagcaaatgttggttggaggagtagtgctcttgggagcaatgctggtcgggcaagtaactctccttgatttgctgaaactcacagtggctgtgggattgcatttccatgagatgaacaatggaggagacgccatgtatatggcgttgattgctgccttttcaatcagaccagggctgctcatcggctttgggctcaggaccctatggagccctcgggaacgccttgtgctgaccctaggagcagccatggtggagattgccttgggtggcgtgatgggcggcctgtggaagtatctaaatgcagtttctctctgcatcctgacaataaatgctgttgcttctaggaaagcatcaaataccatcttgcccctcatggctctgttgacacctgtcactatggctgaggtgagacttgccgcaatgttcttttgtgccgtggttatcataggggtccttcaccagaatttcaaggacacctccatgcagaagactatacctctggtggccctcacactcacatcttacctgggcttgacacaaccttttttgggcctgtgtgcatttctggcaacccgcatatttgggcgaaggagtatcccagtgaatgaggcactcgcagcagctggtctagtgggagtgctggcaggactggcttttcaggagatggagaacttccttggtccgattgcagttggaggactcctgatgatgctggttagcgtggctgggagggtggatgggctagagctcaagaagcttggtgaagtttcatgggaagaggaggcggagatcagcgggagttccgcccgctatgatgtggcactcagtgaacaaggggagttcaagctgctttctgaagagaaagtgccatgggaccaggttgtgatgacctcgctggccttggttggggctgccctccatccatttgctcttctgctggtccttgctgggtggctgtttcatgtcaggggagctaggagaagtggggatgtcttgtgggatattcccactcctaagatcatcgaggaatgtgaacatctggaggatgggatttatggcatattccagtcaaccttcttgggggcctcccagcgaggagtgggagtggcacagggaggggtgttccacacaatgtggcatgtcacaagaggagctttccttgtcaggaatggcaagaagttgattccatcttgggcttcagtaaaggaagaccttgtcgcctatggtggctcatggaagttggaaggcagatgggatggagaggaagaggtccagttgatcgcggctgttccaggaaagaacgtggtcaacgtccagacaaaaccgagcttgttcaaagtgaggaatgggggagaaatcggggctgtcgctcttgactatccgagtggcacttcaggatctcctattgttaacaggaacggagaggtgattgggctgtacggcaatggcatccttgtcggtgacaactccttcgtgtccgccatatcccagactgaggtgaaggaagaaggaaaggaggagctccaagagatcccgacaatgctaaagaaaggaatgacaactgtccttgattttcatcctggagctgggaagacaagacgtttcctcccacagatcttggccgagtgcgcacggagacgcttgcgcactcttgtgttggcccccaccagggttgttctttctgaaatgaaggaggcttttcacggcctggacgtgaaattccacacacaggctttttccgctcacggcagcgggagagaagtcattgatgccatgtgccatgccaccctaacttacaggatgttggaaccaactagggttgttaactgggaagtgatcattatggatgaagcccattttttggatccagctagcatagccgctagaggttgggcagcgcacagagctagggcaaatgaaagtgcaacaatcttgatgacagccacaccgcctgggactagtgatgaatttccacattcaaatggtgaaatagaagatgttcaaacggacatacccagtgagccctggaacacagggcatgactggatcctagctgacaaaaggcccacggcatggttccttccatccatcagagctgcaaatgtcatggctgcctctttgcgtaaggctggaaagagtgtggtggtcctgaacaggaaaacctttgagagagaataccccacgataaagcagaagaaacctgactttatattggccactgacatagctgaaatgggagccaacctttgcgtggagcgagtgctggattgcaggacggcttttaagcctgtgcttgtggatgaagggaggaaggtggcaataaaagggccacttcgtatctccgcatcctctgctgctcaaaggagggggcgcattgggagaaatcccaacagagatggagactcatactactattctgagcctacaagtgaaaataatgcccaccacgtctgctggttggaggcctcaatgctcttggacaacatggaggtgaggggtggaatggtcgccccactctatggcgttgaaggaactaaaacaccagtttcccctggtgaaatgagactgagggatgaccagaggaaagtcttcagagaactagtgaggaattgtgacctgcccgtttggctttcgtggcaagtggccaaggctggtttgaagacgaatgatcgtaagtggtgttttgaaggccctgaggaacatgagatcttgaatgacagcggtgaaacagtgaagtgcagggctcctggaggagcaaagaagcctctgcgcccaaggtggtgtgatgaaagggtgtcatctgaccagagtgcgctgtctgaatttattaagtttgctgaaggtaggaggggagctgctgaagtgctagttgtgctgagtgaactccctgatttcctggctaaaaaaggtggagaggcaatggataccatcagtgtgttcctccactctgaggaaggctctagggcttaccgcaatgcactatcaatgatgcctgaggcaatgacaatagtcatgctgtttatactggctggactactgacatcgggaatggtcatctttttcatgtctcccaaaggcatcagtagaatgtctatggcgatgggcacaatggccggctgtggatatctcatgttccttggaggcgtcaaacccactcacatctcctatgtcatgctcatattctttgtcctgatggtggttgtgatccccgagccagggcaacaaaggtccatccaagacaaccaagtggcatacctcattattggcatcctgacgctggtttcagcggtggcagccaacgagctaggcatgctggagaaaaccaaagaggacctctttgggaagaagaacttaattccatctagtgcttcaccctggagttggccggatcttgacctgaagccaggagctgcctggacagtgtacgttggcattgttacaatgctctctccaatgttgcaccactggatcaaagtcgaatatggcaacctgtctctgtctggaatagcccagtcagcctcagtcctttctttcatggacaaggggataccattcatgaagatgaatatctcggtcataatgctgctggtcagtggctggaattcaataacagtgatgcctctgctctgtggcatagggtgcgccatgctccactggtctctcattttacctggaatcaaagcgcagcagtcaaagcttgcacagagaagggtgttccatggcgttgccgagaaccctgtggttgatgggaatccaacagttgacattgaggaagctcctgaaatgcctgccctttatgagaagaaactggctctatatctccttcttgctctcagcctagcttctgttgccatgtgcagaacgcccttttcattggctgaaggcattgtcctagcatcagctgccttagggccgctcatagagggaaacaccagccttctttggaatggacccatggctgtctccatgacaggagtcatgagggggaatcactatgcttttgtgggagtcatgtacaatctatggaagatgaaaactggacgccgggggagcgcgaatggaaaaactttgggtgaagtctggaagagggaactgaatctgttggacaagcgacagtttgagttgtataaaaggaccgacattgtggaggtggatcgtgatacggcacgcaggcatttggccgaagggaaggtggacaccggggtggcggtctccagggggaccgcaaagttaaggtggttccatgagcgtggctatgtcaagctggaaggtagggtgattgacctggggtgtggccgcggaggctggtgttactacgctgctgcgcaaaaggaagtgagtggggtcaaaggatttactcttggaagagacggccatgagaaacccatgaatgtgcaaagtctgggatggaacatcatcaccttcaaggacaaaactgatatccaccgcctagaaccagtgaaatgtgacacccttttgtgtgacattggagagtcatcatcgtcatcggtcacagagggggaaaggaccgtgagagttcttgatactgtagaaaaatggctggcttgtggggttgacaacttctgtgtgaaggtgttagctccatacatgccagatgttctcgagaaactggaattgctccaaaggaggtttggcggaacagtgatcaggaaccctctctccaggaattccactcatgaaatgtactacgtgtctggagcccgcagcaatgtcacatttactgtgaaccaaacatcccgcctcctgatgaggagaatgaggcgtccaactggaaaagtgaccctggaggctgacgtcatcctcccaattgggacacgcagtgttgagacagacaagggacccctggacaaagaggccatagaagaaagggttgagaggataaaatctgagtacatgacctcttggttttatgacaatgacaacccctacaggacctggcactactgtggctcctatgtcacaaaaacctcaggaagtgcggcgagcatggtaaatggtgttattaaaattctgacatatccatgggacaggatagaggaggtcacaagaatggcaatgactgacacaaccccttttggacagcaaagagtgtttaaagaaaaagttgacaccagagcaaaggatccaccagcgggaactaggaagatcatgaaagttgtcaacaggtggctgttccgccacctggccagagaaaagaaccccagactgtgcacaaaggaagaatttattgcaaaagtccgaagtcatgcagccattggagcttacctggaagaacaagaacagtggaagactgccaatgaggctgtccaagacccaaagttctgggaactggtggatgaagaaaggaagctgcaccaacaaggcaggtgtcggacttgtgtgtacaacatgatggggaaaagagagaagaagctgtcagagtttgggaaagcaaagggaagccgtgccatatggtatatgtggctgggagcgcggtatcttgagtttgaggccctgggattcctgaatgaggaccattgggcttccagggaaaactcaggaggaggagtggaaggcattggcttacaatacctaggatatgtgatcagagacctggctgcaatggatggtggtggattctacgcggatgacaccgctggatgggacacgcgcatcacagaggcagaccttgatgatgaacaggagatcttgaactacatgagcccacatcacaaaaaactggcacaagcagtgatggaaatgacatacaagaacaaagtggtgaaagtgttgagaccagccccaggagggaaagcctacatggatgtcataagtcgacgagaccagagaggatccgggcaggtagtgacttatgctctgaacaccatcaccaacttgaaagtccaattgatcagaatggcagaagcagagatggtgatacatcaccaacatgttcaagattgtgatgaatcagttctgaccaggctggaggcatggctcactgagcacggatgtgacagactgaagaggatggcggtgagtggagacgactgtgtggtccggcccatcgatgacaggttcggcctggccctgtcccatctcaacgccatgtccaaggttagaaaggacatatctgaatggcagccatcaaaagggtggaatgattgggagaatgtgcccttctgttcccaccacttccatgaactacagctgaaggatggcaggaggattgtggtgccttgccgagaacaggacgagctcattgggagaggaagggtgtctccaggaaacggctggatgatcaaggaaacagcttgcctcagcaaagcctatgccaacatgtggtcactgatgtattttcacaaaagggacatgaggctactgtcattggctgtttcctcagctgttcccacctcatgggttccacaaggacgcacaacatggtcgattcatgggaaaggggagtggatgaccacggaagacatgcttgaggtgtggaacagagtatggataaccaacaacccacacatgcaggacaagacaatggtgaaaaaatggagagatgtcccttatctaaccaagagacaagacaagctgtgcggatcactgattggaatgaccaatagggccacctgggcctcccacatccatttagtcatccatcgtatccgaacgctgattggacaggagaaatacactgactacctaacagtcatggacaggtattctgtggatgctgacctgcaactgggtgagcttatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 460 - RNA, 2719 nt, synthetic construct
  misc_feature 1..2719: note = mRNA product Design2 comprising derived and/or modified sequence from YFV 17D__NC_002031.1__C-prME (CDS wt)
  source 1..2719: mol_type = other RNA
ggggcgctgcctacggaggtggcagccatctccttctcggcatcaagcttaccatgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 461 - RNA, 3775 nt, synthetic construct
  misc_feature 1..3775: note = mRNA product Design2 comprising derived and/or modified sequence from YFV 17D__NC_002031.1__C-prME-NS1 (CDS wt)
  source 1..3775: mol_type = other RNA
ggggcgctgcctacggaggtggcagccatctccttctcggcatcaagcttaccatgtctggtcgtaaagctcagggaaaaaccctgggcgtcaatatggtacgacgaggagttcgctccttgtcaaacaaaataaaacaaaaaacaaaacaaattggaaacagacctggaccttcaagaggtgttcaaggatttatctttttctttttgttcaacattttgactggaaaaaagatcacagcccacctaaagaggttgtggaaaatgctggacccaagacaaggcttggctgttctaaggaaagtcaagagagtggtggccagtttgatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagttggcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccaggattcgggatggtctgcagtatggttggaagacttggggtaagaaccttgtgttctccccagggaggaagaatgggagcttcatcatagatggaaagtccaggaaagaatgcccgttttcaaaccgggtctggaactctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcatgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 462 - RNA, 2476 nt, synthetic construct
  misc_feature 1..2476: note = mRNA product Design2 comprising derived and/or modified sequence from YFV 17D__NC_002031.1__X-SS-prME-XX (CDS wt)
  source 1..2476: mol_type = other RNA
ggggcgctgcctacggaggtggcagccatctccttctcggcatcaagcttaccatgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaatccatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 463 - RNA, 1966 nt, synthetic construct
  misc_feature 1..1966: note = mRNA product Design2 comprising derived and/or modified sequence from YFV 17D__NC_002031.1__X-SS-E (CDS wt)
  source 1..1966: mol_type = other RNA
ggggcgctgcctacggaggtggcagccatctccttctcggcatcaagcttaccatgagaggattgtcctcaaggaaacgccgttcccatgatgttctgactgtgcaattcctaattttgggaatgctgttgatgacgggtggagtgaccttggtggctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 464 - RNA, 1996 nt, synthetic construct
  misc_feature 1..1996: note = mRNA product Design2 comprising derived and/or modified sequence from YFV 17D__NC_002031.1__X-SS-E-XX (CDS wt)
  source 1..1996: mol_type = other RNA
ggggcgctgcctacggaggtggcagccatctccttctcggcatcaagcttaccatgagaggattgtcctcaaggaaacgccgttcccatgatgttctgactgtgcaattcctaattttgggaatgctgttgatgacgggtggagtgaccttggtggctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 465 - RNA, 2413 nt, synthetic construct
  misc_feature 1..2413: note = mRNA product Design2 comprising derived and/or modified sequence from YFV 17D__NC_002031.1__SS-prME (CDS wt)
  source 1..2413: mol_type = other RNA
ggggcgctgcctacggaggtggcagccatctccttctcggcatcaagcttaccatggatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 466 - RNA, 3469 nt, synthetic construct
  misc_feature 1..3469: note = mRNA product Design2 comprising derived and/or modified sequence from YFV 17D__NC_002031.1__SS-prME-NS1 (CDS wt)
  source 1..3469: mol_type = other RNA
ggggcgctgcctacggaggtggcagccatctccttctcggcatcaagcttaccatggatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaagggattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaagagagagctcaagtgcggagatggtatcttcatatttagagactctgatgactggctgaacaagtactcatactatccagaagatcctgtgaagttggcatcaatagtgaaagcctcttttgaagaagggaagtgtggcctaaattcagttgactcccttgagcatgagatgtggagaagcagggcagatgagatcaatgccatttttgaggaaaacgaggtggacatttctgttgtcgtgcaggatccaaagaatgtttaccagagaggaactcatccattttccaggattcgggatggtctgcagtatggttggaagacttggggtaagaaccttgtgttctccccagggaggaagaatgggagcttcatcatagatggaaagtccaggaaagaatgcccgttttcaaaccgggtctggaactctttccagatagaggagtttgggacgggagtgttcaccacacgcgtgtacatggacgcagtctttgaatacaccatagactgcgatggatctatcttgggtgcagcggtgaacggaaaaaagagtgcccatggctctccaacattttggatgggaagtcatgaagtaaatgggacatggatgatccacaccttggaggcattagattacaaggagtgtgagtggccactgacacatacgattggaacatcagttgaagagagtgaaatgttcatgccgagatcaatcggaggcccagttagctctcacaatcatatccctggatacaaggttcagacgaacggaccttggatgcaggtaccactagaagtgaagagagaagcatgcccagggactagcgtgatcattgatggcaactgtgatggacggggaaaatcaaccagatccaccacggatagcgggaaagttattcctgaatggtgttgccgctcctgcacaatgccgcctgtgagcttccatggtagtgatgggtgttggtatcccatggaaattaggccaaggaaaacgcatgaaagccatctggtgcgctcctgggttacagcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 467 - RNA, 10618 nt, synthetic construct
  misc_feature 1..10618: note = mRNA product Design2 comprising derived and/or modified sequence from YFV 17D__NC_002031.1__polyprotein (CDS opt1)
  source 1..10618: mol_type = other RNA
ggggcgctgcctacggaggtggcagccatctccttctcggcatcaagcttaccatgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctgtacaagctccacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtgaaggtcagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagagcgcccacgggtccccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtgcccctcgaggtgaagcgggaggcctgcccgggcaccagcgtcatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtaccccatggagatccggccccgcaagacgcacgagtcccacctggtccggagctgggtgaccgccggcgagatccacgccgtgcccttcgggctggtctccatgatgatcgccatggaggtggtgctccgcaagcggcagggccccaagcagatgctggtcggcggggtggtgctgctcggcgcgatgctggtcgggcaggtgaccctgctcgacctgctgaagctcaccgtggccgtcggcctgcacttccacgagatgaacaacgggggcgacgccatgtacatggccctgatcgccgcgttcagcatccgcccgggcctcctgatcgggttcggcctgcgcacgctctggagcccccgggagcgcctggtgctgaccctcggggccgccatggtggagatcgccctgggcggggtcatgggcggcctgtggaagtacctcaacgcggtgtccctgtgcatcctgaccatcaacgccgtggccagccggaaggcctccaacaccatcctccccctgatggccctgctcacccccgtcacgatggcggaggtgcgcctggccgccatgttcttctgcgccgtggtcatcatcggggtgctgcaccagaacttcaaggacaccagcatgcagaagaccatcccgctcgtggccctgaccctgacgtcctacctcggcctgacccagcccttcctggggctctgcgcgttcctggccacccggatcttcggccgccggagcatccccgtcaacgaggccctggccgccgcggggctcgtgggcgtgctggccggcctggccttccaggagatggagaacttcctcgggcccatcgccgtcggcgggctgctgatgatgctcgtgtccgtggccggccgcgtcgacggcctggagctgaagaagctcggggaggtgagctgggaggaggaggcggagatctccggcagctccgcccggtacgacgtggccctgagcgagcagggggagttcaagctgctctccgaggagaaggtcccgtgggaccaggtggtgatgaccagcctggccctggtcggcgcggccctccaccccttcgccctgctgctcgtgctggccgggtggctgttccacgtgcgcggcgcccggcgctccggcgacgtcctctgggacatccccacgcccaagatcatcgaggagtgcgagcacctggaggacgggatctacggcatcttccagagcaccttcctgggggcgtcccagcggggcgtgggggtcgcccagggcggcgtgttccacaccatgtggcacgtgacccgcggggccttcctcgtccggaacggcaagaagctgatcccgagctgggcctccgtgaaggaggacctggtggcctacgggggcagctggaagctcgaggggcgctgggacggcgaggaggaggtccagctgatcgcggccgtgcccggcaagaacgtggtcaacgtgcagacgaagcccagcctgttcaaggtgcggaacgggggcgagatcggggccgtcgccctggactacccgtccggcaccagcgggtcccccatcgtgaaccgcaacggcgaggtgatcggcctctacgggaacggcatcctggtcggggacaacagcttcgtgtccgccatcagccagaccgaggtgaaggaggagggcaaggaggagctgcaggagatccccaccatgctcaagaagggcatgacgaccgtcctggacttccaccccggggcgggcaagacccggcgcttcctgccgcagatcctcgccgagtgcgcccgccggcgcctgcggaccctggtgctcgcccccacgcgcgtggtcctgtccgagatgaaggaggcgttccacgggctggacgtgaagttccacacccaggccttcagcgcccacggctccgggcgggaggtgatcgacgccatgtgccacgccaccctcacctaccgcatgctggagcccacgcgggtcgtgaactgggaggtgatcatcatggacgaggcgcacttcctggaccccgccagcatcgccgcccgcggctgggccgcgcaccgggcccgcgccaacgagtccgccaccatcctcatgaccgccaccccgcccggcacgagcgacgagttcccccactccaacggggagatcgaggacgtccagaccgacatccccagcgagccgtggaacaccggccacgactggatcctggcggacaagcggcccaccgcctggttcctgccctccatccgcgccgccaacgtgatggcggccagcctccggaaggccgggaagtccgtggtcgtgctgaaccgcaagacgttcgagcgggagtaccccaccatcaagcagaagaagccggacttcatcctggccaccgacatcgccgagatgggcgcgaacctctgcgtggagcgcgtcctggactgccggaccgccttcaagcccgtgctggtggacgaggggcgcaaggtcgccatcaagggccccctccggatcagcgcctccagcgccgcgcagcgccggggccgcatcgggcgcaaccccaaccgggacggcgacagctactactactccgagccgacgagcgagaacaacgcccaccacgtgtgctggctggaggcctccatgctgctcgacaacatggaggtgcgcgggggcatggtcgccccgctgtacggggtggagggcaccaagacccccgtgagccccggcgagatgcggctgcgcgacgaccagcggaaggtcttccgcgagctcgtgcggaactgcgacctgccggtgtggctgtcctggcaggtcgccaaggcggggctcaagaccaacgaccgcaagtggtgcttcgagggccccgaggagcacgagatcctgaacgacagcggggagaccgtgaagtgccgggcccccggcggcgccaagaagcccctgcgcccgcggtggtgcgacgagcgcgtgtccagcgaccagtccgccctcagcgagttcatcaagttcgccgaggggcggcgcggcgcggccgaggtcctggtggtgctgtccgagctccccgacttcctggccaagaagggcggcgaggccatggacacgatcagcgtcttcctgcactccgaggaggggagccgggcgtaccgcaacgccctctccatgatgcccgaggccatgaccatcgtgatgctgttcatcctggccgggctcctgaccagcggcatggtcatcttcttcatgtccccgaaggggatcagccggatgtccatggccatgggcaccatggcggggtgcggctacctgatgttcctcgggggcgtgaagcccacgcacatcagctacgtgatgctgatcttcttcgtcctgatggtggtggtcatccccgagcccggccagcagcgcagcatccaggacaaccaggtggcctacctcatcatcgggatcctgaccctggtgtccgccgtcgccgccaacgagctcggcatgctggagaagaccaaggaggacctgttcgggaagaagaacctcatcccgagctccgcgagcccctggtcctggcccgacctggacctgaagcccggcgccgcctggaccgtgtacgtggggatcgtcacgatgctcagcccgatgctgcaccactggatcaaggtggagtacggcaacctgtccctcagcggcatcgcccagtccgccagcgtgctgtccttcatggacaaggggatccccttcatgaagatgaacatcagcgtcatcatgctgctcgtgtccggctggaacagcatcaccgtgatgcccctgctgtgcgggatcggctgcgcgatgctccactggtccctgatcctgcccgggatcaaggcccagcagagcaagctcgcccagcggcgcgtcttccacggcgtggccgagaacccggtggtcgacggcaaccccaccgtggacatcgaggaggcgcccgagatgcccgccctgtacgagaagaagctggccctctacctgctgctcgccctgtccctggccagcgtggcgatgtgccgcaccccgttctccctcgccgaggggatcgtcctggccagcgccgccctgggccccctcatcgaggggaacacgagcctgctgtggaacggccccatggcggtgtccatgaccggcgtgatgcgggggaaccactacgccttcgtcggcgtgatgtacaacctctggaagatgaagaccgggcgccggggcagcgccaacgggaagaccctgggcgaggtgtggaagcgcgagctgaacctcctggacaagcggcagttcgagctgtacaagcgcacggacatcgtcgaggtggaccgggacaccgcccgccggcacctcgccgagggcaaggtggacaccggggtcgcggtgtcccgcggcaccgccaagctgcggtggttccacgagcgcgggtacgtgaagctggagggccgggtcatcgacctcgggtgcggccgcggcgggtggtgctactacgccgccgcgcagaaggaggtgagcggcgtgaaggggttcacgctgggccgggacgggcacgagaagcccatgaacgtccagtccctgggctggaacatcatcaccttcaaggacaagaccgacatccaccgcctggagccggtgaagtgcgacaccctcctgtgcgacatcggcgagagctccagctccagcgtgacggagggggagcggaccgtccgcgtgctggacaccgtggagaagtggctcgcctgcggcgtcgacaacttctgcgtgaaggtgctggccccctacatgcccgacgtcctggagaagctcgagctgctgcagcggcgcttcgggggcaccgtgatccggaaccccctctcccgcaacagcacgcacgagatgtactacgtgtccggcgcccgcagcaacgtcaccttcaccgtgaaccagacctcccggctgctgatgcgccggatgcgccggccgacggggaaggtcaccctcgaggccgacgtgatcctgcccatcggcacccgcagcgtggagaccgacaaggggcccctggacaaggaggcgatcgaggagcgggtcgagcgcatcaagtccgagtacatgacgagctggttctacgacaacgacaacccctaccggacctggcactactgcggcagctacgtgaccaagacctccgggagcgccgcctccatggtgaacggcgtcatcaagatcctcacgtacccgtgggaccgcatcgaggaggtgacccggatggccatgaccgacaccacccccttcggccagcagcgcgtgttcaaggagaaggtcgacacgcgggccaaggacccgccggcggggacccgcaagatcatgaaggtggtgaaccggtggctgttccgccacctggcccgggagaagaacccccgcctctgcaccaaggaggagttcatcgccaaggtccggagccacgccgccatcggcgcgtacctggaggagcaggagcagtggaagaccgccaacgaggccgtgcaggaccccaagttctgggagctggtggacgaggagcgcaagctccaccagcaggggcgctgccggacgtgcgtctacaacatgatgggcaagcgcgagaagaagctgtccgagttcgggaaggccaagggcagccgggccatctggtacatgtggctgggcgcgcgctacctcgagttcgaggccctggggttcctgaacgaggaccactgggcctcccgggagaacagcggcgggggcgtggaggggatcggcctccagtacctgggctacgtgatccgcgacctggccgcgatggacgggggcgggttctacgccgacgacaccgccggctgggacacccggatcaccgaggccgacctcgacgacgagcaggagatcctgaactacatgtccccgcaccacaagaagctggcccaggcggtcatggagatgacgtacaagaacaaggtggtgaaggtcctccgcccggcccccgggggcaaggcctacatggacgtgatcagccggcgcgaccagcggggctccgggcaggtggtcacctacgccctgaacaccatcaccaacctgaaggtgcagctcatccgcatggccgaggcggagatggtgatccaccaccagcacgtccaggactgcgacgagagcgtgctgacgcggctggaggcctggctcaccgagcacggctgcgaccgcctgaagcggatggccgtgtccggggacgactgcgtcgtgcgccccatcgacgaccggttcggcctggccctcagccacctgaacgccatgtccaaggtgcgcaaggacatcagcgagtggcagccctccaagggctggaacgactgggagaacgtccccttctgcagccaccacttccacgagctgcagctcaaggacgggcggcgcatcgtggtgccctgccgggagcaggacgagctgatcggccgcgggcgcgtctcccccggcaacgggtggatgatcaaggagaccgcgtgcctgagcaaggcctacgccaacatgtggagcctcatgtacttccacaagcgggacatgcgcctgctgtccctcgccgtgagctccgcggtgcccaccagctgggtcccgcagggccggacgacctggtccatccacggcaagggggagtggatgaccaccgaggacatgctggaggtgtggaaccgcgtgtggatcacgaacaacccccacatgcaggacaagaccatggtcaagaagtggcgggacgtgccctacctgaccaagcgccaggacaagctctgcggcagcctgatcgggatgaccaaccgggccacgtgggcctcccacatccacctggtgatccaccgcatccggaccctcatcggccaggagaagtacaccgactacctgaccgtcatggaccgctacagcgtggacgccgacctgcagctcggggagctgatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 468 - RNA, 2719 nt, synthetic construct
  misc_feature 1..2719: note = mRNA product Design2 comprising derived and/or modified sequence from YFV 17D__NC_002031.1__C-prME (CDS opt1) R2611/R2612
  source 1..2719: mol_type = other RNA
ggggcgctgcctacggaggtggcagccatctccttctcggcatcaagcttaccatgagcggccggaaggcccaggggaagaccctgggcgtgaacatggtccgccggggcgtgcgctccctcagcaacaagatcaagcagaagaccaagcagatcgggaaccggcccgggccgtcccgcggcgtgcagggcttcatcttcttcttcctgttcaacatcctgacggggaagaagatcaccgcccacctcaagcggctgtggaagatgctggacccccgccagggcctcgcggtcctgcggaaggtgaagcgcgtggtcgccagcctgatgcgggggctctccagccgcaagcggcgcagccacgacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 469 - RNA, 3775 nt, synthetic construct
  misc_feature 1..3775: note = mRNA product Design2 comprising derived and/or modified sequence from YFV 17D__NC_002031.1__C-prME-NS1 (CDS opt1) R2587/R2588
  source 1..3775: mol_type = other RNA
ggggcgctgcctacggaggtggcagccatctccttctcggcatcaagcttaccatgagcggccggaaggcccaggggaagaccctgggcgtgaacatggtccgccggggcgtgcgctccctcagcaacaagatcaagcagaagaccaagcagatcgggaaccggcccgggccgtcccgcggcgtgcagggcttcatcttcttcttcctgttcaacatcctgacggggaagaagatcaccgcccacctcaagcggctgtggaagatgctggacccccgccagggcctcgcggtcctgcggaaggtgaagcgcgtggtcgccagcctgatgcgggggctctccagccgcaagcggcgcagccacgacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgccgaccagggctgcgccatcaacttcgggaagcgggagctgaagtgcggcgacgggatcttcatcttccgcgacagcgacgactggctcaacaagtactcctactaccccgaggacccggtgaagctggccagcatcgtcaaggcgtccttcgaggagggcaagtgcgggctgaacagcgtggactccctcgagcacgagatgtggcggagccgcgccgacgagatcaacgccatcttcgaggagaacgaggtggacatctccgtcgtggtgcaggaccccaagaacgtctaccagcggggcacccaccccttcagccgcatccgggacggcctgcagtacgggtggaagacctggggcaagaacctggtgttctcccccgggcgcaagaacggcagcttcatcatcgacgggaagtcccggaaggagtgcccgttcagcaaccgcgtgtggaactccttccagatcgaggagttcggcacgggcgtcttcaccacccgggtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccgcagcatcgggggcccggtcagctcccacaaccacatccccgggtacaaggtgcagaccaacggcccctggatgcaggtgcccctggaggtcaagcgggaggcctgcccgggcaccagcgtgatcatcgacgggaactgcgacggccgcgggaagtccacgcggagcaccaccgactccggcaaggtgatccccgagtggtgctgccgcagctgcaccatgccgcccgtctccttccacgggagcgacggctgctggtacccgatggagatccggccccgcaagacgcacgagtcccacctggtgcggagctgggtgaccgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 470 - RNA, 2476 nt, synthetic construct
  misc_feature 1..2476: note = mRNA product Design2 comprising derived and/or modified sequence from YFV 17D__NC_002031.1__X-SS-prME-XX (CDS opt1) R2581/R2582
  source 1..2476: mol_type = other RNA
ggggcgctgcctacggaggtggcagccatctccttctcggcatcaagcttaccatgcggggcctgagctcccgcaagcggcgcagccacgacgtgctcaccgtccagttcctgatcctggggatgctcctgatgaccggcggggtgacgctggtgcggaagaaccgctggctcctgctgaacgtcacctccgaggacctcggcaagaccttcagcgtggggaccggcaactgcacgaccaacatcctggaggccaagtactggtgccccgactccatggagtacaactgcccgaacctgagcccccgggaggagcccgacgacatcgactgctggtgctacggcgtggagaacgtccgcgtggcctacgggaagtgcgactccgcgggccggagccgccggtcccgccgggccatcgacctccccacccacgagaaccacgggctgaagacccgccaggagaagtggatgacgggccggatgggggagcgccagctgcagaagatcgagcggtggttcgtgcgcaacccgttcttcgccgtcaccgccctcaccatcgcctacctggtgggcagcaacatgacccagcgggtggtcatcgcgctgctcgtgctggccgtgggccccgcctactccgcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 471 - RNA, 1966 nt, synthetic construct
  misc_feature 1..1966: note = mRNA product Design2 comprising derived and/or modified sequence from YFV 17D__NC_002031.1__X-SS-E (CDS opt1)
  source 1..1966: mol_type = other RNA
ggggcgctgcctacggaggtggcagccatctccttctcggcatcaagcttaccatgcggggcctgagctcccgcaagcggcgcagccacgacgtgctcaccgtccagttcctgatcctggggatgctcctgatgaccggcggggtgacgctggtggcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 472 - RNA, 1996 nt, synthetic construct
  misc_feature 1..1996: note = mRNA product Design2 comprising derived and/or modified sequence from YFV 17D__NC_002031.1__X-SS-E-XX (CDS opt1)
  source 1..1996: mol_type = other RNA
ggggcgctgcctacggaggtggcagccatctccttctcggcatcaagcttaccatgcggggcctgagctcccgcaagcggcgcagccacgacgtgctcaccgtccagttcctgatcctggggatgctcctgatgaccggcggggtgacgctggtggcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccggggctgggggaacggctgcgggctgttcggcaagggctccatcgtcgcctgcgccaagttcacgtgcgcgaagagcatgtccctgttcgaggtggaccagaccaagatccagtacgtcatccgcgcccagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatcccggtgatcgtcgccgacgacctgaccgccgccatcaacaagggcatcctggtgaccgtgaacccgatcgccagcacgaacgacgacgaggtcctcatcgaggtgaacccccccttcggcgactcctacatcatcgtggggcggggcgacagccgcctgacctaccagtggcacaaggaggggtccagcatcggcaagctgttcacccagaccatgaagggggtcgagcggctggcggtgatgggcgacacggcctgggacttctccagcgccggcgggttcttcacctccgtgggcaaggggatccacaccgtcttcggcagcgccttccaggggctcttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 473 - RNA, 2413 nt, synthetic construct
  misc_feature 1..2413: note = mRNA product Design2 comprising derived and/or modified sequence from YFV 17D__NC_002031.1__SS-prME (CDS opt1) R2607/R2608
  source 1..2413: mol_type = other RNA
ggggcgctgcctacggaggtggcagccatctccttctcggcatcaagcttaccatggacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 474 - RNA, 3469 nt, synthetic construct
  misc_feature 1..3469: note = mRNA product Design2 comprising derived and/or modified sequence from YFV 17D__NC_002031.1__SS-prME-NS1 (CDS opt1) R2615/R2616
  source 1..3469: mol_type = other RNA
ggggcgctgcctacggaggtggcagccatctccttctcggcatcaagcttaccatggacgtgctgaccgtccagttcctcatcctgggcatgctgctcatgaccgggggcgtgaccctggtccggaagaaccgctggctcctgctgaacgtgaccagcgaggacctcggcaagacgttctccgtggggaccggcaactgcaccaccaacatcctggaggccaagtactggtgccccgacagcatggagtacaactgccccaacctgtccccgcgggaggagcccgacgacatcgactgctggtgctacggggtcgagaacgtgcgcgtggcctacggcaagtgcgacagcgcggggcggtcccgccggagccgccgggccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgcgctgaccatcgcctacctcgtggggagcaacatgacccagcgcgtggtcatcgccctgctggtgctcgccgtgggccccgcctactccgcgcactgcatcgggatcacggaccgggacttcatcgagggcgtccacggcgggacctgggtgagcgccaccctggagcaggacaagtgcgtgaccgtcatggcccccgacaagccctccctggacatcagcctcgagacggtggccatcgaccgcccggcggaggtgcggaaggtctgctacaacgccgtgctgacccacgtgaagatcaacgacaagtgcccctccaccggcgaggcccacctggccgaggagaacgagggggacaacgcctgcaagcgcacctacagcgaccggggctgggggaacggctgcggcctcttcgggaagggctccatcgtcgcgtgcgccaagttcacgtgcgccaagagcatgtccctgttcgaggtggaccagaccaagatccagtacgtgatccgcgcccagctgcacgtcggggccaagcaggagaactggaacaccgacatcaagaccctcaagttcgacgcgctgagcggctcccaggaggtggagttcatcggctacgggaaggccacgctggagtgccaggtgcagaccgccgtcgacttcggcaacagctacatcgccgagatggagaccgagtcctggatcgtggaccggcagtgggcccaggacctcaccctgccctggcagagcgggtccggcggggtgtggcgcgagatgcaccacctggtcgagttcgagcccccgcacgcggccacgatccgggtgctcgccctgggcaaccaggagggcagcctgaagaccgccctcaccggggccatgcgcgtcaccaaggacacgaacgacaacaacctgtacaagctgcacggcgggcacgtgtcctgccgggtgaagctcagcgcgctgaccctgaagggcacctcctacaagatctgcaccgacaagatgttcttcgtcaagaaccccacggacaccgggcacggcaccgtggtgatgcaggtcaaggtgagcaagggcgccccctgccgcatcccggtgatcgtcgccgacgacctcaccgccgcgatcaacaaggggatcctggtgacggtgaaccccatcgccagcaccaacgacgacgaggtcctgatcgaggtgaacccgcccttcggcgactcctacatcatcgtggggcggggcgacagccgcctcacctaccagtggcacaaggaggggtccagcatcggcaagctgttcacccagacgatgaagggcgtcgagcggctggccgtgatgggggacaccgcctgggacttctccagcgccggcgggttcttcacctccgtgggcaagggcatccacaccgtcttcgggagcgcgttccagggcctcttcgggggcctgaactggatcaccaaggtgatcatgggggccgtgctgatctgggtcggcatcaacacgcgcaacatgaccatgtccatgagcatgatcctcgtgggcgtgatcatgatgttcctgtccctgggggtcggcgccgaccagggctgcgccatcaacttcgggaagcgggagctgaagtgcggcgacgggatcttcatcttccgcgacagcgacgactggctcaacaagtactcctactaccccgaggacccggtgaagctggccagcatcgtcaaggcgtccttcgaggagggcaagtgcgggctgaacagcgtggactccctcgagcacgagatgtggcggagccgcgccgacgagatcaacgccatcttcgaggagaacgaggtggacatctccgtcgtggtgcaggaccccaagaacgtctaccagcggggcacccaccccttcagccgcatccgggacggcctgcagtacgggtggaagacctggggcaagaacctggtgttctcccccgggcgcaagaacggcagcttcatcatcgacgggaagtcccggaaggagtgcccgttcagcaaccgcgtgtggaactccttccagatcgaggagttcggcacgggcgtcttcaccacccgggtgtacatggacgccgtgttcgagtacaccatcgactgcgacgggagcatcctcggcgccgcggtcaacgggaagaagtccgcccacggcagccccacgttctggatgggctcccacgaggtgaacgggacctggatgatccacaccctggaggccctggactacaaggagtgcgagtggcccctcacccacacgatcggcaccagcgtggaggagtccgagatgttcatgccccgcagcatcgggggcccggtcagctcccacaaccacatccccgggtacaaggtgcagaccaacggcccctggatgcaggtgcccctggaggtcaagcgggaggcctgcccgggcaccagcgtgatcatcgacgggaactgcgacggccgcgggaagtccacgcggagcaccaccgactccggcaaggtgatccccgagtggtgctgccgcagctgcaccatgccgcccgtctccttccacgggagcgacggctgctggtacccgatggagatccggccccgcaagacgcacgagtcccacctggtgcggagctgggtgaccgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 475 - RNA, 10618 nt, synthetic construct
  misc_feature 1..10618: note = mRNA product Design2 comprising derived and/or modified sequence from YFV 17D__NC_002031.1__polyprotein (CDS opt1)
  source 1..10618: mol_type = other RNA
ggggcgctgcctacggaggtggcagccatctccttctcggcatcaagcttaccatgagcgggcgcaaggcccaggggaagaccctgggggtgaacatggtgcggcgcggggtgcggtccctcagcaacaagatcaagcagaagaccaagcagatcggcaaccgccccgggccctcccggggcgtgcagggcttcatcttcttcttcctgttcaacatcctgacggggaagaagatcaccgcccacctcaagcgcctgtggaagatgctggacccccggcagggcctcgccgtgctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaacccgaccgacacgggccacggcaccgtcgtgatgcaggtcaaggtcagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagtccgcccacgggtccccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtccccctcgaggtgaagcgggaggcctgcccgggcaccagcgtcatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtacccgatggagatccggccccgcaagacgcacgagtcccacctggtccggagctgggtgaccgccggcgagatccacgccgtgcccttcgggctggtctccatgatgatcgccatggaggtggtgctccgcaagcggcagggccccaagcagatgctggtcggcggggtggtgctgctcggcgcgatgctggtcggccaggtgaccctgctcgacctgctgaagctcaccgtggccgtcggcctgcacttccacgagatgaacaacgggggcgacgccatgtacatggccctgatcgccgcgttcagcatccgcccgggcctcctgatcgggttcggcctgcgcacgctctggagcccccgggagcgcctggtgctgaccctcggggccgccatggtggagatcgccctgggcggggtcatgggcggcctgtggaagtacctcaacgcggtgtccctgtgcatcctgaccatcaacgccgtggccagccggaaggcctccaacaccatcctccccctgatggccctgctcacccccgtcacgatggcggaggtgcgcctggccgccatgttcttctgcgccgtggtcatcatcggggtgctgcaccagaacttcaaggacaccagcatgcagaagaccatcccgctcgtggccctgaccctgacgtcctacctcggcctgacccagcccttcctggggctctgcgcgttcctggccacccggatcttcggccgccggagcatccccgtcaacgaggccctggccgccgcggggctcgtgggcgtgctggccggcctggccttccaggagatggagaacttcctcgggcccatcgccgtcggcgggctgctgatgatgctcgtgtccgtggccggccgcgtcgacggcctggagctgaagaagctcggggaggtgagctgggaggaggaggcggagatctccggcagctccgcccggtacgacgtggccctgagcgagcagggggagttcaagctgctctccgaggagaaggtcccgtgggaccaggtggtgatgaccagcctggccctggtcggcgcggccctccaccccttcgccctgctgctcgtgctggccgggtggctgttccacgtgcgcggcgcccggcgctccggcgacgtcctctgggacatccccacgcccaagatcatcgaggagtgcgagcacctggaggacgggatctacggcatcttccagagcaccttcctgggggcgtcccagcggggcgtgggggtcgcccagggcggcgtgttccacaccatgtggcacgtgacccgcggggccttcctcgtccggaacggcaagaagctgatcccgagctgggcctccgtgaaggaggacctggtggcctacgggggcagctggaagctcgaggggcgctgggacggcgaggaggaggtccagctgatcgcggccgtgcccggcaagaacgtggtcaacgtgcagacgaagcccagcctgttcaaggtgcggaacgggggcgagatcggggccgtcgccctggactacccgtccggcaccagcgggtcccccatcgtgaaccgcaacggcgaggtgatcggcctctacgggaacggcatcctggtcggggacaacagcttcgtgtccgccatcagccagaccgaggtgaaggaggagggcaaggaggagctgcaggagatccccaccatgctcaagaagggcatgacgaccgtcctggacttccaccccggggcgggcaagacccggcgcttcctgccgcagatcctcgccgagtgcgcccgccggcgcctgcggaccctggtgctcgcccccacgcgcgtggtcctgtccgagatgaaggaggcgttccacgggctggacgtgaagttccacacccaggccttcagcgcccacggctccgggcgggaggtgatcgacgccatgtgccacgccaccctcacctaccgcatgctggagcccacgcgggtcgtgaactgggaggtgatcatcatggacgaggcgcacttcctggaccccgccagcatcgccgcccgcggctgggccgcgcaccgggcccgcgccaacgagtccgccaccatcctcatgaccgccaccccgcccggcacgagcgacgagttcccccactccaacggggagatcgaggacgtccagaccgacatccccagcgagccgtggaacaccggccacgactggatcctggcggacaagcggcccaccgcctggttcctgccctccatccgcgccgccaacgtgatggcggccagcctccggaaggccgggaagtccgtggtcgtgctgaaccgcaagacgttcgagcgggagtaccccaccatcaagcagaagaagccggacttcatcctggccaccgacatcgccgagatgggcgcgaacctctgcgtggagcgcgtcctggactgccggaccgccttcaagcccgtgctggtggacgaggggcgcaaggtcgccatcaagggccccctccggatcagcgcctccagcgccgcgcagcgccggggccgcatcgggcgcaaccccaaccgggacggcgacagctactactactccgagccgacgagcgagaacaacgcccaccacgtgtgctggctggaggcctccatgctgctcgacaacatggaggtgcgcgggggcatggtcgcgcccctgtacggggtggagggcaccaagacccccgtgagccccggcgagatgcggctgcgcgacgaccagcggaaggtcttccgcgagctcgtgcggaactgcgacctgccggtgtggctgtcctggcaggtcgccaaggcggggctcaagaccaacgaccgcaagtggtgcttcgagggccccgaggagcacgagatcctgaacgacagcggggagaccgtgaagtgccgggcccccggcggcgccaagaagcccctgcgcccgcggtggtgcgacgagcgcgtgtccagcgaccagtccgccctcagcgagttcatcaagttcgccgaggggcggcgcggcgcggccgaggtcctggtggtgctgtccgagctccccgacttcctggccaagaagggcggggaggccatggacacgatcagcgtcttcctgcactccgaggaggggagccgggcgtaccgcaacgccctctccatgatgcccgaggccatgaccatcgtgatgctgttcatcctggccggcctcctgaccagcggcatggtcatcttcttcatgtccccgaaggggatcagccggatgtccatggccatgggcaccatggcggggtgcggctacctgatgttcctcgggggcgtgaagcccacgcacatcagctacgtgatgctgatcttcttcgtcctgatggtggtggtcatccccgagcccggccagcagcgcagcatccaggacaaccaggtggcctacctcatcatcgggatcctgaccctggtgtccgccgtcgccgccaacgagctcggcatgctggagaagaccaaggaggacctgttcgggaagaagaacctcatcccgagctccgcgagcccctggtcctggcccgacctggacctgaagcccggcgccgcctggaccgtgtacgtggggatcgtcacgatgctcagcccgatgctgcaccactggatcaaggtggagtacggcaacctgtccctcagcggcatcgcccagtccgccagcgtgctgtccttcatggacaaggggatccccttcatgaagatgaacatcagcgtcatcatgctgctcgtgtccggctggaacagcatcaccgtgatgcccctgctgtgcgggatcggctgcgcgatgctccactggtccctgatcctgcccgggatcaaggcccagcagagcaagctcgcccagcggcgcgtcttccacggcgtggccgagaacccggtggtcgacggcaaccccaccgtggacatcgaggaggcgcccgagatgcccgccctgtacgagaagaagctggccctctacctgctgctcgccctgtccctggccagcgtggcgatgtgccgcaccccgttctccctcgccgaggggatcgtcctggccagcgccgccctgggccccctcatcgaggggaacacgagcctgctgtggaacggccccatggcggtgtccatgaccggcgtgatgcgggggaaccactacgccttcgtcggcgtgatgtacaacctctggaagatgaagaccgggcgccggggcagcgccaacgggaagaccctgggcgaggtgtggaagcgcgagctgaacctcctggacaagcggcagttcgagctgtacaagcgcacggacatcgtcgaggtggaccgggacaccgcccgccggcacctcgccgagggcaaggtggacaccggggtcgcggtgtcccgcggcaccgccaagctgcggtggttccacgagcgcgggtacgtgaagctggagggccgggtcatcgacctcgggtgcggccgcggcgggtggtgctactacgccgccgcgcagaaggaggtgagcggcgtgaaggggttcacgctgggccgggacgggcacgagaagcccatgaacgtccagtccctgggctggaacatcatcaccttcaaggacaagaccgacatccaccgcctcgagccggtgaagtgcgacaccctgctgtgcgacatcggcgagagctccagctccagcgtgacggagggggagcggaccgtccgcgtgctggacaccgtggagaagtggctcgcctgcggcgtcgacaacttctgcgtgaaggtgctggccccctacatgcccgacgtcctggagaagctcgagctgctgcagcggcgcttcgggggcaccgtgatccggaaccccctctcccgcaacagcacgcacgagatgtactacgtgtccggcgcccgcagcaacgtcaccttcaccgtgaaccagacctcccggctgctgatgcgccggatgcgccggccgacggggaaggtcaccctcgaggccgacgtgatcctgcccatcggcacccgcagcgtggagaccgacaaggggcccctggacaaggaggcgatcgaggagcgggtcgagcgcatcaagtccgagtacatgacgagctggttctacgacaacgacaacccctaccggacctggcactactgcggcagctacgtgaccaagacctccgggagcgccgcctccatggtgaacggcgtcatcaagatcctcacgtacccgtgggaccgcatcgaggaggtgacccggatggccatgaccgacaccacccccttcggccagcagcgcgtgttcaaggagaaggtcgacacgcgggccaaggacccgcccgcggggacccgcaagatcatgaaggtggtgaaccggtggctgttccgccacctggcccgggagaagaacccccgcctctgcaccaaggaggagttcatcgccaaggtccggagccacgccgccatcggcgcgtacctggaggagcaggagcagtggaagaccgccaacgaggccgtgcaggaccccaagttctgggagctggtggacgaggagcgcaagctccaccagcaggggcgctgccggacgtgcgtctacaacatgatgggcaagcgcgagaagaagctgtccgagttcgggaaggccaagggcagccgggccatctggtacatgtggctgggcgcgcgctacctcgagttcgaggccctggggttcctgaacgaggaccactgggcctcccgggagaacagcggcgggggcgtggaggggatcggcctccagtacctgggctacgtgatccgcgacctggccgcgatggacgggggcgggttctacgccgacgacaccgccggctgggacacccggatcaccgaggccgacctcgacgacgagcaggagatcctgaactacatgagcccccaccacaagaagctggcccaggcggtcatggagatgacgtacaagaacaaggtggtgaaggtcctccgccccgcccccgggggcaaggcctacatggacgtgatcagccggcgcgaccagcggggctccggccaggtggtcacctacgccctgaacaccatcaccaacctgaaggtgcagctcatccgcatggccgaggcggagatggtgatccaccaccagcacgtccaggactgcgacgagagcgtgctgacgcggctggaggcctggctcaccgagcacggctgcgaccgcctgaagcggatggccgtgtccggggacgactgcgtcgtgcgccccatcgacgaccggttcggcctggccctcagccacctgaacgccatgtccaaggtgcgcaaggacatcagcgagtggcagccctccaagggctggaacgactgggagaacgtcccgttctgcagccaccacttccacgagctgcagctcaaggacgggcggcgcatcgtggtgccctgccgggagcaggacgagctgatcggccgcgggcgcgtctcccccggcaacgggtggatgatcaaggagaccgcgtgcctgagcaaggcctacgccaacatgtggagcctcatgtacttccacaagcgggacatgcgcctgctgtccctcgccgtgagctccgcggtgcccaccagctgggtcccgcagggccggacgacctggtccatccacggcaagggggagtggatgaccaccgaggacatgctggaggtgtggaaccgcgtgtggatcacgaacaacccccacatgcaggacaagaccatggtcaagaagtggcgggacgtgccctacctgaccaagcgccaggacaagctctgcggcagcctgatcgggatgaccaaccgggccacgtgggcctcccacatccacctggtgatccaccgcatccggaccctcatcggccaggagaagtacaccgactacctgaccgtcatggaccgctacagcgtggacgccgacctgcagctcggggagctgatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 476 - RNA, 2719 nt, synthetic construct
  misc_feature 1..2719: note = mRNA product Design2 comprising derived and/or modified sequence from YFV 17D__NC_002031.1__C-prME (CDS opt1)
  source 1..2719: mol_type = other RNA
ggggcgctgcctacggaggtggcagccatctccttctcggcatcaagcttaccatgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtcaaggtgagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 477 - RNA, 3775 nt, synthetic construct
  misc_feature 1..3775: note = mRNA product Design2 comprising derived and/or modified sequence from YFV 17D__NC_002031.1__C-prME-NS1 (CDS opt1)
  source 1..3775: mol_type = other RNA
ggggcgctgcctacggaggtggcagccatctccttctcggcatcaagcttaccatgagcggccgcaaggcccaggggaagaccctgggcgtgaacatggtccggcgcggggtgcggtccctcagcaacaagatcaagcagaagaccaagcagatcggcaaccgccccgggccgtcccggggcgtgcagggcttcatcttcttcttcctgttcaacatcctgacggggaagaagatcaccgcccacctcaagcgcctgtggaagatgctggacccccggcagggcctcgcggtcctgcgcaaggtgaagcgggtggtcgccagcctgatgcgcgggctctccagccggaagcgccggtcccacgacgtgctgaccgtgcagttcctgatcctcggcatgctgctgatgaccgggggcgtcacgctcgtgcgcaagaaccggtggctgctgctcaacgtgaccagcgaggacctgggcaagaccttctccgtcgggaccggcaactgcacgaccaacatcctggaggccaagtactggtgccccgacagcatggagtacaactgccccaacctctccccgcgcgaggagcccgacgacatcgactgctggtgctacggggtggagaacgtgcgggtcgcctacggcaagtgcgacagcgccggccgctcccggcgcagccggcgcgcgatcgacctgcccacccacgagaaccacgggctgaagacccgccaggagaagtggatgacgggccggatgggggagcgccagctccagaagatcgagcggtggttcgtgcgcaaccccttcttcgccgtgaccgccctgaccatcgcctacctggtcggctccaacatgacccagcgggtggtgatcgcgctcctggtcctggccgtggggccggcctacagcgcccactgcatcggcatcacggaccgcgacttcatcgagggcgtgcacgggggcacctgggtctccgccaccctcgagcaggacaagtgcgtgaccgtcatggcgcccgacaagcccagcctggacatctccctggagacggtggccatcgaccggcccgccgaggtgcgcaaggtctgctacaacgccgtgctcacccacgtgaagatcaacgacaagtgcccgagcaccggggaggcccacctggcggaggagaacgagggcgacaacgcctgcaagcggacctacagcgaccgcgggtggggcaacggctgcgggctgttcggcaaggggtccatcgtcgcctgcgccaagttcacgtgcgccaagagcatgtccctcttcgaggtggaccagaccaagatccagtacgtgatccgggcgcagctgcacgtcggcgccaagcaggagaactggaacaccgacatcaagaccctgaagttcgacgccctcagcgggtcccaggaggtggagttcatcggctacggcaaggccacgctggagtgccaggtgcagaccgccgtcgacttcgggaacagctacatcgcggagatggagaccgagtcctggatcgtggaccgccagtgggcccaggacctgaccctcccctggcagagcggctccgggggcgtgtggcgggagatgcaccacctggtcgagttcgagccgccccacgccgccacgatccgcgtgctggcgctcggcaaccaggaggggagcctgaagaccgccctgaccggcgccatgcgggtgaccaaggacacgaacgacaacaacctctacaagctgcacgggggccacgtctcctgccgcgtgaagctgagcgccctgaccctcaaggggacctcctacaagatctgcaccgacaagatgttcttcgtgaagaaccccaccgacacgggccacggcaccgtcgtgatgcaggtcaaggtgagcaagggggccccctgccggatccccgtgatcgtggcggacgacctgaccgccgccatcaacaagggcatcctggtcaccgtgaaccccatcgcctccacgaacgacgacgaggtgctcatcgaggtcaacccgcccttcggggacagctacatcatcgtgggccgcggggactcccggctgacctaccagtggcacaaggagggcagctccatcggcaagctgttcacccagaccatgaagggggtggagcgcctcgccgtcatgggcgacacggcgtgggacttcagcagcgccgggggcttcttcacctccgtggggaagggcatccacaccgtgttcggcagcgccttccaggggctgttcggcgggctgaactggatcaccaaggtcatcatgggcgccgtgctcatctgggtggggatcaacacgcgcaacatgaccatgtccatgagcatgatcctggtcggcgtgatcatgatgttcctgtccctcggcgtgggggccgaccagggctgcgcgatcaacttcgggaagcgggagctgaagtgcggcgacggcatcttcatcttccgcgacagcgacgactggctgaacaagtactcctactaccccgaggaccccgtcaagctcgccagcatcgtgaaggcctccttcgaggaggggaagtgcggcctgaacagcgtggactccctggagcacgagatgtggcggagccgcgccgacgagatcaacgcgatcttcgaggagaacgaggtcgacatctccgtggtggtccaggacccgaagaacgtgtaccagcgggggacccaccccttcagccgcatccgggacggcctccagtacgggtggaagacctggggcaagaacctggtgttctcccccggccgcaagaacgggagcttcatcatcgacggcaagtcccggaaggagtgccccttcagcaaccgcgtctggaacagcttccagatcgaggagttcgggacgggcgtgttcaccacccgggtctacatggacgccgtgttcgagtacaccatcgactgcgacgggtccatcctgggcgccgccgtgaacggcaagaagtccgcccacgggagcccgacgttctggatgggcagccacgaggtcaacgggacctggatgatccacaccctcgaggcgctggactacaaggagtgcgagtggcccctgacccacacgatcggcacctccgtggaggagagcgagatgttcatgccccgctccatcgggggcccggtgagctcccacaaccacatccccggctacaaggtccagaccaacgggccctggatgcaggtccccctcgaggtgaagcgggaggcctgcccgggcaccagcgtgatcatcgacgggaactgcgacggccgcggcaagtccacgcggagcaccaccgactccgggaaggtgatccccgagtggtgctgccgcagctgcaccatgccgcccgtgtccttccacggcagcgacgggtgctggtaccccatggagatccggccccgcaagacgcacgagtcccacctggtccggagctgggtgaccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 478 - RNA, 2476 nt, synthetic construct
  misc_feature 1..2476: note = mRNA product Design2 comprising derived and/or modified sequence from YFV 17D__NC_002031.1__X-SS-prME-XX (CDS opt1)
  source 1..2476: mol_type = other RNA
ggggcgctgcctacggaggtggcagccatctccttctcggcatcaagcttaccatgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccgccagtgggcccaggacctgaccctgccctggcagtccggcagcggcggggtctggcgggagatgcaccacctcgtggagttcgagcccccgcacgccgccacgatccgcgtgctggcgctgggcaaccaggaggggtccctcaagaccgccctgaccggcgccatgcgggtcaccaaggacacgaacgacaacaacctgtacaagctccacgggggccacgtgagctgccgcgtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccggatccccgtgatcgtcgccgacgacctgaccgccgccatcaacaagggcatcctggtgaccgtgaacccgatcgccagcacgaacgacgacgaggtcctcatcgaggtgaacccgcccttcggcgactcctacatcatcgtggggcgcggcgacagccggctgacctaccagtggcacaaggaggggtccagcatcggcaagctgttcacccagaccatgaagggggtcgagcgcctcgcggtgatgggcgacacggcctgggacttctccagcgccggcgggttcttcacctccgtgggcaaggggatccacaccgtcttcggcagcgccttccaggggctgttcggcggcctgaactggatcaccaaggtgatcatgggggccgtgctgatctgggtcggcatcaacacgcggaacatgaccatgtccatgagcatgatcctcgtgggggtgatcatgatgttcctgagcctgggcgtcggggcggaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 479 - RNA, 1966 nt, synthetic construct
  misc_feature 1..1966: note = mRNA product Design2 comprising derived and/or modified sequence from YFV 17D__NC_002031.1__X-SS-E (CDS opt1)
  source 1..1966: mol_type = other RNA
ggggcgctgcctacggaggtggcagccatctccttctcggcatcaagcttaccatgcgcggcctgagctcccggaagcgccggagccacgacgtgctcaccgtccagttcctgatcctggggatgctcctgatgaccggcggggtgacgctggtggcccactgcatcggcatcaccgaccgcgacttcatcgagggggtccacggcggcacctgggtgtccgccaccctcgagcaggacaagtgcgtgacggtcatggcgcccgacaagcccagcctggacatctccctggagaccgtggccatcgaccggcccgccgaggtgcgcaaggtctgctacaacgccgtgctcacccacgtgaagatcaacgacaagtgccccagcaccggggaggcccacctggcggaggagaacgagggcgacaacgcctgcaagcggacgtactccgaccgcgggtggggcaacgggtgcggcctgttcggcaaggggagcatcgtcgcctgcgccaagttcacgtgcgcgaagtccatgagcctcttcgaggtggaccagaccaagatccagtacgtgatccgggcccagctgcacgtcggcgccaagcaggagaactggaacaccgacatcaagaccctgaagttcgacgccctctccgggagccaggaggtggagttcatcggctacggcaaggccaccctggagtgccaggtgcagaccgcggtcgacttcgggaactcctacatcgccgagatggagaccgagagctggatcgtggaccgccagtgggcccaggacctgacgctcccctggcagtccggcagcgggggcgtgtggcgggagatgcaccacctggtcgagttcgagccgccccacgccgccaccatccgcgtgctggcgctcgggaaccaggagggctccctgaagaccgccctgaccggcgccatgcgggtgacgaaggacaccaacgacaacaacctctacaagctgcacgggggccacgtcagctgccgcgtgaagctgtccgccctcaccctgaaggggaccagctacaagatctgcacggacaagatgttcttcgtcaagaaccccaccgacaccggccacgggaccgtggtgatgcaggtcaaggtgagcaagggcgccccctgccggatcccggtgatcgtcgcggacgacctgacggccgccatcaacaagggcatcctcgtgaccgtgaaccccatcgcctccaccaacgacgacgaggtcctgatcgaggtgaacccgcccttcggggacagctacatcatcgtgggccgcggggactcccggctgacctaccagtggcacaaggagggcagctccatcgggaagctgttcacgcagaccatgaagggcgtcgagcgcctcgccgtgatgggcgacaccgcgtgggacttcagctccgccgggggcttcttcaccagcgtggggaagggcatccacacggtcttcggctccgccttccaggggctgttcggcgggctcaactggatcaccaaggtgatcatgggcgccgtgctgatctgggtcgggatcaacacccggaacatgaccatgagcatgtccatgatcctggtgggcgtgatcatgatgttcctcagcctgggcgtcggggcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 480 - RNA, 1996 nt, synthetic construct
  misc_feature 1..1996: note = mRNA product Design2 comprising derived and/or modified sequence from YFV 17D__NC_002031.1__X-SS-E-XX (CDS opt1)
  source 1..1996: mol_type = other RNA
ggggcgctgcctacggaggtggcagccatctccttctcggcatcaagcttaccatgcgcggcctgagctcccggaagcgccggagccacgacgtgctcaccgtccagttcctgatcctggggatgctcctgatgaccggcggggtgacgctggtggcccactgcatcggcatcaccgaccgcgacttcatcgagggggtccacggcggcacctgggtgtccgccaccctcgagcaggacaagtgcgtgacggtcatggcgcccgacaagcccagcctggacatctccctggagaccgtggccatcgaccggcccgccgaggtgcgcaaggtctgctacaacgccgtgctcacccacgtgaagatcaacgacaagtgccccagcaccggggaggcccacctggcggaggagaacgagggcgacaacgcctgcaagcggacgtactccgaccgcgggtggggcaacgggtgcggcctgttcggcaaggggagcatcgtcgcctgcgccaagttcacgtgcgcgaagtccatgagcctcttcgaggtggaccagaccaagatccagtacgtgatccgggcccagctgcacgtcggcgccaagcaggagaactggaacaccgacatcaagaccctgaagttcgacgccctctccgggagccaggaggtggagttcatcggctacggcaaggccaccctggagtgccaggtgcagaccgcggtcgacttcgggaactcctacatcgccgagatggagaccgagagctggatcgtggaccgccagtgggcccaggacctgacgctcccctggcagtccggcagcgggggcgtgtggcgggagatgcaccacctggtcgagttcgagccgccccacgccgccaccatccgcgtgctggcgctcgggaaccaggagggctccctgaagaccgccctgaccggcgccatgcgggtgacgaaggacaccaacgacaacaacctctacaagctgcacgggggccacgtcagctgccgcgtgaagctgtccgccctcaccctgaaggggaccagctacaagatctgcacggacaagatgttcttcgtcaagaaccccaccgacaccggccacgggaccgtggtgatgcaggtcaaggtgagcaagggcgccccctgccggatcccggtgatcgtcgcggacgacctgacggccgccatcaacaagggcatcctcgtgaccgtgaaccccatcgcctccaccaacgacgacgaggtcctgatcgaggtgaacccgcccttcggggacagctacatcatcgtgggccgcggggactcccggctgacctaccagtggcacaaggagggcagctccatcgggaagctgttcacgcagaccatgaagggcgtcgagcgcctcgccgtgatgggcgacaccgcgtgggacttcagctccgccgggggcttcttcaccagcgtggggaagggcatccacacggtcttcggctccgccttccaggggctgttcggcgggctcaactggatcaccaaggtgatcatgggcgccgtgctgatctgggtcgggatcaacacccggaacatgaccatgagcatgtccatgatcctggtgggcgtgatcatgatgttcctcagcctgggcgtcggggcggaccagggctgcgccatcaacttcgggaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 481 - RNA, 2413 nt, synthetic construct
  misc_feature 1..2413: note = mRNA product Design2 comprising derived and/or modified sequence from YFV 17D__NC_002031.1__SS-prME (CDS opt1)
  source 1..2413: mol_type = other RNA
ggggcgctgcctacggaggtggcagccatctccttctcggcatcaagcttaccatggacgtgctgaccgtccagttcctcatcctgggcatgctgctcatgaccgggggcgtgacgctggtgcgcaagaaccggtggctgctcctgaacgtcaccagcgaggacctggggaagaccttctccgtgggcaccgggaactgcacgaccaacatcctcgaggccaagtactggtgccccgacagcatggagtacaactgccccaacctgagcccccgcgaggagcccgacgacatcgactgctggtgctacggcgtggagaacgtccgggtggcctacggcaagtgcgactccgcggggcgctcccggcgcagccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggtccaacatgacccagcgcgtggtcatcgcgctgctggtgctcgccgtgggccccgcctacagcgcccactgcatcggcatcacggaccgggacttcatcgagggggtccacggcgggacctgggtgtccgcgaccctggagcaggacaagtgcgtgaccgtcatggcccccgacaagcccagcctggacatctccctcgagacggtggccatcgaccgcccggccgaggtgcggaaggtctgctacaacgccgtgctgacccacgtgaagatcaacgacaagtgccccagcaccggcgaggcgcacctggccgaggagaacgagggcgacaacgcctgcaagcgcacctactccgaccgggggtggggcaacgggtgcggcctcttcgggaagggcagcatcgtcgcctgcgccaagttcacgtgcgcgaagtccatgagcctgttcgaggtggaccagaccaagatccagtacgtcatccgcgcccagctgcacgtgggcgccaagcaggagaactggaacaccgacatcaagaccctcaagttcgacgccctgtccgggagccaggaggtggagttcatcggctacgggaaggccacgctggagtgccaggtccagaccgcggtggacttcggcaactcctacatcgccgagatggagaccgagagctggatcgtggaccggcagtgggcccaggacctcaccctgccctggcagagcgggtccggcggcgtctggcgcgagatgcaccacctggtggagttcgagcccccgcacgccgccacgatccgcgtgctcgcgctggggaaccaggagggcagcctgaagaccgccctcaccggggccatgcgggtcaccaaggacacgaacgacaacaacctgtacaagctgcacggcgggcacgtgtcctgccgcgtgaagctcagcgccctgaccctgaagggcacctcctacaagatctgcaccgacaagatgttcttcgtcaagaaccccacggacaccggccacgggaccgtggtgatgcaggtcaaggtgagcaagggcgcgccctgccggatccccgtgatcgtcgccgacgacctcaccgccgccatcaacaaggggatcctggtgaccgtgaacccgatcgcctccacgaacgacgacgaggtcctgatcgaggtgaacccgcccttcggcgacagctacatcatcgtgggccgcggggactcccggctcacctaccagtggcacaaggagggcagctccatcgggaagctgttcacccagaccatgaagggcgtcgagcgcctggcggtgatgggggacacggcctgggacttcagctccgccggcggcttcttcaccagcgtggggaagggcatccacaccgtcttcgggtccgccttccagggcctcttcgggggcctgaactggatcaccaaggtgatcatgggcgccgtgctgatctgggtcgggatcaacacgcggaacatgaccatgagcatgtccatgatcctggtgggcgtgatcatgatgttcctcagcctgggggtcggcgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 482 - RNA, 3469 nt, synthetic construct
  misc_feature 1..3469: note = mRNA product Design2 comprising derived and/or modified sequence from YFV 17D__NC_002031.1__SS-prME-NS1 (CDS opt1)
  source 1..3469: mol_type = other RNA
ggggcgctgcctacggaggtggcagccatctccttctcggcatcaagcttaccatggacgtgctgaccgtccagttcctcatcctgggcatgctgctcatgaccgggggcgtgacgctggtgcgcaagaaccggtggctgctcctgaacgtcaccagcgaggacctggggaagaccttctccgtgggcaccgggaactgcacgaccaacatcctcgaggccaagtactggtgccccgacagcatggagtacaactgcccgaacctgagcccccgcgaggagcccgacgacatcgactgctggtgctacggcgtggagaacgtccgggtggcctacggcaagtgcgactccgcggggcgctcccggcgcagccggcgcgccatcgacctgcccacccacgagaaccacggcctcaagacccggcaggagaagtggatgacggggcgcatgggcgagcggcagctgcagaagatcgagcgctggttcgtgcggaacccgttcttcgccgtcaccgccctgaccatcgcctacctcgtggggtccaacatgacccagcgcgtggtcatcgcgctgctggtgctcgccgtgggccccgcctacagcgcccactgcatcggcatcacggaccgggacttcatcgagggggtccacggcgggacctgggtgtccgcgaccctggagcaggacaagtgcgtgaccgtcatggcccccgacaagcccagcctggacatctccctcgagacggtggccatcgaccgcccggccgaggtgcggaaggtctgctacaacgccgtgctgacccacgtgaagatcaacgacaagtgccccagcaccggcgaggcgcacctggccgaggagaacgagggcgacaacgcctgcaagcgcacctactccgaccgggggtggggcaacgggtgcggcctcttcgggaagggcagcatcgtcgcctgcgccaagttcacgtgcgcgaagtccatgagcctgttcgaggtggaccagaccaagatccagtacgtcatccgcgcccagctgcacgtgggcgccaagcaggagaactggaacaccgacatcaagaccctcaagttcgacgccctgtccgggagccaggaggtggagttcatcggctacgggaaggccacgctggagtgccaggtccagaccgcggtggacttcggcaactcctacatcgccgagatggagaccgagagctggatcgtggaccggcagtgggcccaggacctcaccctgccctggcagagcgggtccggcggcgtctggcgcgagatgcaccacctggtggagttcgagcccccgcacgccgccacgatccgcgtgctcgcgctggggaaccaggagggcagcctgaagaccgccctcaccggggccatgcgggtcaccaaggacacgaacgacaacaacctgtacaagctgcacggcgggcacgtgtcctgccgcgtgaagctcagcgccctgaccctgaagggcacctcctacaagatctgcaccgacaagatgttcttcgtcaagaaccccacggacaccggccacgggaccgtggtgatgcaggtcaaggtgagcaagggcgcgccctgccggatccccgtgatcgtcgccgacgacctcaccgccgccatcaacaaggggatcctggtgaccgtgaacccgatcgcctccacgaacgacgacgaggtcctgatcgaggtgaacccgcccttcggcgacagctacatcatcgtgggccgcggggactcccggctcacctaccagtggcacaaggagggcagctccatcgggaagctgttcacccagaccatgaagggcgtcgagcgcctggcggtgatgggggacacggcctgggacttcagctccgccggcggcttcttcaccagcgtggggaagggcatccacaccgtcttcgggtccgccttccagggcctcttcgggggcctgaactggatcaccaaggtgatcatgggcgccgtgctgatctgggtcgggatcaacacgcggaacatgaccatgagcatgtccatgatcctggtgggcgtgatcatgatgttcctcagcctgggggtcggcgcggaccaggggtgcgccatcaacttcggcaagcgcgagctgaagtgcggcgacgggatcttcatcttccgggactccgacgactggctcaacaagtacagctactaccccgaggaccccgtgaagctggccagcatcgtgaaggcctccttcgaggagggcaagtgcgggctgaacagcgtcgactccctcgagcacgagatgtggcgcagccgggccgacgagatcaacgcgatcttcgaggagaacgaggtggacatctccgtggtcgtgcaggaccccaagaacgtgtaccagcgcggcacccaccccttcagccggatccgcgacgggctgcagtacggctggaagacctggggcaagaacctggtcttctcccccgggcggaagaacggcagcttcatcatcgacgggaagtcccgcaaggagtgcccgttcagcaaccgggtgtggaactccttccagatcgaggagttcggcacgggcgtgttcaccacccgcgtctacatggacgccgtgttcgagtacaccatcgactgcgacgggagcatcctcggcgccgccgtgaacgggaagaagtccgcgcacggcagccccacgttctggatggggtcccacgaggtcaacggcacctggatgatccacaccctggaggccctggactacaaggagtgcgagtggcccctcacccacacgatcggcaccagcgtggaggagtccgagatgttcatgccccggagcatcgggggcccggtgagctcccacaaccacatccccgggtacaaggtccagaccaacggcccctggatgcaggtcccgctggaggtgaagcgcgaggcctgccccgggaccagcgtgatcatcgacggcaactgcgacggccgcgggaagtccacgcggagcaccaccgactccggcaaggtgatccccgagtggtgctgccgcagctgcaccatgcccccggtctccttccacgggagcgacggctgctggtaccccatggagatccggccccgcaagacgcacgagtcccacctggtgcggagctgggtgaccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 483 - RNA, 10618 nt, synthetic construct
  misc_feature 1..10618: note = mRNA product Design2 comprising derived and/or modified sequence from YFV 17D__NC_002031.1__polyprotein (CDS opt2)
  source 1..10618: mol_type = other RNA
ggggcgctgcctacggaggtggcagccatctccttctcggcatcaagcttaccatgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgccggcgagatccacgccgtccccttcggcctcgtctccatgatgatcgccatggaggtcgtcctccgcaagcgccagggccccaagcagatgctcgtcggcggcgtcgtcctcctcggcgccatgctcgtcggccaggtcaccctcctcgacctcctcaagctcaccgtcgccgtcggcctccacttccacgagatgaacaacggcggcgacgccatgtacatggccctcatcgccgccttctccatccgccccggcctcctcatcggcttcggcctccgcaccctctggtccccccgcgagcgcctcgtcctcaccctcggcgccgccatggtcgagatcgccctcggcggcgtcatgggcggcctctggaagtacctcaacgccgtctccctctgcatcctcaccatcaacgccgtcgcctcccgcaaggcctccaacaccatcctccccctcatggccctcctcacccccgtcaccatggccgaggtccgcctcgccgccatgttcttctgcgccgtcgtcatcatcggcgtcctccaccagaacttcaaggacacctccatgcagaagaccatccccctcgtcgccctcaccctcacctcctacctcggcctcacccagcccttcctcggcctctgcgccttcctcgccacccgcatcttcggccgccgctccatccccgtcaacgaggccctcgccgccgccggcctcgtcggcgtcctcgccggcctcgccttccaggagatggagaacttcctcggccccatcgccgtcggcggcctcctcatgatgctcgtctccgtcgccggccgcgtcgacggcctcgagctcaagaagctcggcgaggtctcctgggaggaggaggccgagatctccggctcctccgcccgctacgacgtcgccctctccgagcagggcgagttcaagctcctctccgaggagaaggtcccctgggaccaggtcgtcatgacctccctcgccctcgtcggcgccgccctccaccccttcgccctcctcctcgtcctcgccggctggctcttccacgtccgcggcgcccgccgctccggcgacgtcctctgggacatccccacccccaagatcatcgaggagtgcgagcacctcgaggacggcatctacggcatcttccagtccaccttcctcggcgcctcccagcgcggcgtcggcgtcgcccagggcggcgtcttccacaccatgtggcacgtcacccgcggcgccttcctcgtccgcaacggcaagaagctcatcccctcctgggcctccgtcaaggaggacctcgtcgcctacggcggctcctggaagctcgagggccgctgggacggcgaggaggaggtccagctcatcgccgccgtccccggcaagaacgtcgtcaacgtccagaccaagccctccctcttcaaggtccgcaacggcggcgagatcggcgccgtcgccctcgactacccctccggcacctccggctcccccatcgtcaaccgcaacggcgaggtcatcggcctctacggcaacggcatcctcgtcggcgacaactccttcgtctccgccatctcccagaccgaggtcaaggaggagggcaaggaggagctccaggagatccccaccatgctcaagaagggcatgaccaccgtcctcgacttccaccccggcgccggcaagacccgccgcttcctcccccagatcctcgccgagtgcgcccgccgccgcctccgcaccctcgtcctcgcccccacccgcgtcgtcctctccgagatgaaggaggccttccacggcctcgacgtcaagttccacacccaggccttctccgcccacggctccggccgcgaggtcatcgacgccatgtgccacgccaccctcacctaccgcatgctcgagcccacccgcgtcgtcaactgggaggtcatcatcatggacgaggcccacttcctcgaccccgcctccatcgccgcccgcggctgggccgcccaccgcgcccgcgccaacgagtccgccaccatcctcatgaccgccaccccccccggcacctccgacgagttcccccactccaacggcgagatcgaggacgtccagaccgacatcccctccgagccctggaacaccggccacgactggatcctcgccgacaagcgccccaccgcctggttcctcccctccatccgcgccgccaacgtcatggccgcctccctccgcaaggccggcaagtccgtcgtcgtcctcaaccgcaagaccttcgagcgcgagtaccccaccatcaagcagaagaagcccgacttcatcctcgccaccgacatcgccgagatgggcgccaacctctgcgtcgagcgcgtcctcgactgccgcaccgccttcaagcccgtcctcgtcgacgagggccgcaaggtcgccatcaagggccccctccgcatctccgcctcctccgccgcccagcgccgcggccgcatcggccgcaaccccaaccgcgacggcgactcctactactactccgagcccacctccgagaacaacgcccaccacgtctgctggctcgaggcctccatgctcctcgacaacatggaggtccgcggcggcatggtcgcccccctctacggcgtcgagggcaccaagacccccgtctcccccggcgagatgcgcctccgcgacgaccagcgcaaggtcttccgcgagctcgtccgcaactgcgacctccccgtctggctctcctggcaggtcgccaaggccggcctcaagaccaacgaccgcaagtggtgcttcgagggccccgaggagcacgagatcctcaacgactccggcgagaccgtcaagtgccgcgcccccggcggcgccaagaagcccctccgcccccgctggtgcgacgagcgcgtctcctccgaccagtccgccctctccgagttcatcaagttcgccgagggccgccgcggcgccgccgaggtcctcgtcgtcctctccgagctccccgacttcctcgccaagaagggcggcgaggccatggacaccatctccgtcttcctccactccgaggagggctcccgcgcctaccgcaacgccctctccatgatgcccgaggccatgaccatcgtcatgctcttcatcctcgccggcctcctcacctccggcatggtcatcttcttcatgtcccccaagggcatctcccgcatgtccatggccatgggcaccatggccggctgcggctacctcatgttcctcggcggcgtcaagcccacccacatctcctacgtcatgctcatcttcttcgtcctcatggtcgtcgtcatccccgagcccggccagcagcgctccatccaggacaaccaggtcgcctacctcatcatcggcatcctcaccctcgtctccgccgtcgccgccaacgagctcggcatgctcgagaagaccaaggaggacctcttcggcaagaagaacctcatcccctcctccgcctccccctggtcctggcccgacctcgacctcaagcccggcgccgcctggaccgtctacgtcggcatcgtcaccatgctctcccccatgctccaccactggatcaaggtcgagtacggcaacctctccctctccggcatcgcccagtccgcctccgtcctctccttcatggacaagggcatccccttcatgaagatgaacatctccgtcatcatgctcctcgtctccggctggaactccatcaccgtcatgcccctcctctgcggcatcggctgcgccatgctccactggtccctcatcctccccggcatcaaggcccagcagtccaagctcgcccagcgccgcgtcttccacggcgtcgccgagaaccccgtcgtcgacggcaaccccaccgtcgacatcgaggaggcccccgagatgcccgccctctacgagaagaagctcgccctctacctcctcctcgccctctccctcgcctccgtcgccatgtgccgcacccccttctccctcgccgagggcatcgtcctcgcctccgccgccctcggccccctcatcgagggcaacacctccctcctctggaacggccccatggccgtctccatgaccggcgtcatgcgcggcaaccactacgccttcgtcggcgtcatgtacaacctctggaagatgaagaccggccgccgcggctccgccaacggcaagaccctcggcgaggtctggaagcgcgagctcaacctcctcgacaagcgccagttcgagctctacaagcgcaccgacatcgtcgaggtcgaccgcgacaccgcccgccgccacctcgccgagggcaaggtcgacaccggcgtcgccgtctcccgcggcaccgccaagctccgctggttccacgagcgcggctacgtcaagctcgagggccgcgtcatcgacctcggctgcggccgcggcggctggtgctactacgccgccgcccagaaggaggtctccggcgtcaagggcttcaccctcggccgcgacggccacgagaagcccatgaacgtccagtccctcggctggaacatcatcaccttcaaggacaagaccgacatccaccgcctcgagcccgtcaagtgcgacaccctcctctgcgacatcggcgagtcctcctcctcctccgtcaccgagggcgagcgcaccgtccgcgtcctcgacaccgtcgagaagtggctcgcctgcggcgtcgacaacttctgcgtcaaggtcctcgccccctacatgcccgacgtcctcgagaagctcgagctcctccagcgccgcttcggcggcaccgtcatccgcaaccccctctcccgcaactccacccacgagatgtactacgtctccggcgcccgctccaacgtcaccttcaccgtcaaccagacctcccgcctcctcatgcgccgcatgcgccgccccaccggcaaggtcaccctcgaggccgacgtcatcctccccatcggcacccgctccgtcgagaccgacaagggccccctcgacaaggaggccatcgaggagcgcgtcgagcgcatcaagtccgagtacatgacctcctggttctacgacaacgacaacccctaccgcacctggcactactgcggctcctacgtcaccaagacctccggctccgccgcctccatggtcaacggcgtcatcaagatcctcacctacccctgggaccgcatcgaggaggtcacccgcatggccatgaccgacaccacccccttcggccagcagcgcgtcttcaaggagaaggtcgacacccgcgccaaggacccccccgccggcacccgcaagatcatgaaggtcgtcaaccgctggctcttccgccacctcgcccgcgagaagaacccccgcctctgcaccaaggaggagttcatcgccaaggtccgctcccacgccgccatcggcgcctacctcgaggagcaggagcagtggaagaccgccaacgaggccgtccaggaccccaagttctgggagctcgtcgacgaggagcgcaagctccaccagcagggccgctgccgcacctgcgtctacaacatgatgggcaagcgcgagaagaagctctccgagttcggcaaggccaagggctcccgcgccatctggtacatgtggctcggcgcccgctacctcgagttcgaggccctcggcttcctcaacgaggaccactgggcctcccgcgagaactccggcggcggcgtcgagggcatcggcctccagtacctcggctacgtcatccgcgacctcgccgccatggacggcggcggcttctacgccgacgacaccgccggctgggacacccgcatcaccgaggccgacctcgacgacgagcaggagatcctcaactacatgtccccccaccacaagaagctcgcccaggccgtcatggagatgacctacaagaacaaggtcgtcaaggtcctccgccccgcccccggcggcaaggcctacatggacgtcatctcccgccgcgaccagcgcggctccggccaggtcgtcacctacgccctcaacaccatcaccaacctcaaggtccagctcatccgcatggccgaggccgagatggtcatccaccaccagcacgtccaggactgcgacgagtccgtcctcacccgcctcgaggcctggctcaccgagcacggctgcgaccgcctcaagcgcatggccgtctccggcgacgactgcgtcgtccgccccatcgacgaccgcttcggcctcgccctctcccacctcaacgccatgtccaaggtccgcaaggacatctccgagtggcagccctccaagggctggaacgactgggagaacgtccccttctgctcccaccacttccacgagctccagctcaaggacggccgccgcatcgtcgtcccctgccgcgagcaggacgagctcatcggccgcggccgcgtctcccccggcaacggctggatgatcaaggagaccgcctgcctctccaaggcctacgccaacatgtggtccctcatgtacttccacaagcgcgacatgcgcctcctctccctcgccgtctcctccgccgtccccacctcctgggtcccccagggccgcaccacctggtccatccacggcaagggcgagtggatgaccaccgaggacatgctcgaggtctggaaccgcgtctggatcaccaacaacccccacatgcaggacaagaccatggtcaagaagtggcgcgacgtcccctacctcaccaagcgccaggacaagctctgcggctccctcatcggcatgaccaaccgcgccacctgggcctcccacatccacctcgtcatccaccgcatccgcaccctcatcggccaggagaagtacaccgactacctcaccgtcatggaccgctactccgtcgacgccgacctccagctcggcgagctcatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 484 - RNA, 2719 nt, synthetic construct
  misc_feature 1..2719: note = mRNA product Design2 comprising derived and/or modified sequence from YFV 17D__NC_002031.1__C-prME (CDS opt2)
  source 1..2719: mol_type = other RNA
ggggcgctgcctacggaggtggcagccatctccttctcggcatcaagcttaccatgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 485 - RNA, 3775 nt, synthetic construct
  misc_feature 1..3775: note = mRNA product Design2 comprising derived and/or modified sequence from YFV 17D__NC_002031.1__C-prME-NS1 (CDS opt2)
  source 1..3775: mol_type = other RNA
ggggcgctgcctacggaggtggcagccatctccttctcggcatcaagcttaccatgtccggccgcaaggcccagggcaagaccctcggcgtcaacatggtccgccgcggcgtccgctccctctccaacaagatcaagcagaagaccaagcagatcggcaaccgccccggcccctcccgcggcgtccagggcttcatcttcttcttcctcttcaacatcctcaccggcaagaagatcaccgcccacctcaagcgcctctggaagatgctcgacccccgccagggcctcgccgtcctccgcaaggtcaagcgcgtcgtcgcctccctcatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 486 - RNA, 2476 nt, synthetic construct
  misc_feature 1..2476: note = mRNA product Design2 comprising derived and/or modified sequence from YFV 17D__NC_002031.1__X-SS-prME-XX (CDS opt2)
  source 1..2476: mol_type = other RNA
ggggcgctgcctacggaggtggcagccatctccttctcggcatcaagcttaccatgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 487 - RNA, 1966 nt, synthetic construct
  misc_feature 1..1966: note = mRNA product Design2 comprising derived and/or modified sequence from YFV 17D__NC_002031.1__X-SS-E (CDS opt2)
  source 1..1966: mol_type = other RNA
ggggcgctgcctacggaggtggcagccatctccttctcggcatcaagcttaccatgcgcggcctctcctcccgcaagcgccgctcccacgacgtcctcaccgtccagttcctcatcctcggcatgctcctcatgaccggcggcgtcaccctcgtcgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 488 - RNA, 1996 nt, synthetic construct
  misc_feature 1..1996: note = mRNA product Design2 comprising derived and/or modified sequence from YFV 17D__NC_002031.1__X-SS-E-XX (CDS opt2)
  source 1..1996: mol_type = other RNA
ggggcgctgcctacggaggtggcagccatctccttctcggcatcaagcttaccatgcgcggcctctcctcccgcaagcgccgctcccacgacgtcctcaccgtccagttcctcatcctcggcatgctcctcatgaccggcggcgtcaccctcgtcgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 489 - RNA, 2413 nt, synthetic construct
  misc_feature 1..2413: note = mRNA product Design2 comprising derived and/or modified sequence from YFV 17D__NC_002031.1__SS-prME (CDS opt2)
  source 1..2413: mol_type = other RNA
ggggcgctgcctacggaggtggcagccatctccttctcggcatcaagcttaccatggacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 490 - RNA, 3469 nt, synthetic construct
  misc_feature 1..3469: note = mRNA product Design2 comprising derived and/or modified sequence from YFV 17D__NC_002031.1__SS-prME-NS1 (CDS opt2)
  source 1..3469: mol_type = other RNA
ggggcgctgcctacggaggtggcagccatctccttctcggcatcaagcttaccatggacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaagcgcgagctcaagtgcggcgacggcatcttcatcttccgcgactccgacgactggctcaacaagtactcctactaccccgaggaccccgtcaagctcgcctccatcgtcaaggcctccttcgaggagggcaagtgcggcctcaactccgtcgactccctcgagcacgagatgtggcgctcccgcgccgacgagatcaacgccatcttcgaggagaacgaggtcgacatctccgtcgtcgtccaggaccccaagaacgtctaccagcgcggcacccaccccttctcccgcatccgcgacggcctccagtacggctggaagacctggggcaagaacctcgtcttctcccccggccgcaagaacggctccttcatcatcgacggcaagtcccgcaaggagtgccccttctccaaccgcgtctggaactccttccagatcgaggagttcggcaccggcgtcttcaccacccgcgtctacatggacgccgtcttcgagtacaccatcgactgcgacggctccatcctcggcgccgccgtcaacggcaagaagtccgcccacggctcccccaccttctggatgggctcccacgaggtcaacggcacctggatgatccacaccctcgaggccctcgactacaaggagtgcgagtggcccctcacccacaccatcggcacctccgtcgaggagtccgagatgttcatgccccgctccatcggcggccccgtctcctcccacaaccacatccccggctacaaggtccagaccaacggcccctggatgcaggtccccctcgaggtcaagcgcgaggcctgccccggcacctccgtcatcatcgacggcaactgcgacggccgcggcaagtccacccgctccaccaccgactccggcaaggtcatccccgagtggtgctgccgctcctgcaccatgccccccgtctccttccacggctccgacggctgctggtaccccatggagatccgcccccgcaagacccacgagtcccacctcgtccgctcctgggtcaccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 491 - RNA, 10618 nt, synthetic construct
  misc_feature 1..10618: note = mRNA product Design2 comprising derived and/or modified sequence from YFV 17D__NC_002031.1__polyprotein (CDS opt3)
  source 1..10618: mol_type = other RNA
ggggcgctgcctacggaggtggcagccatctccttctcggcatcaagcttaccatgagcggcaggaaggcccaggggaaaaccctgggagtgaacatggtcaggcggggtgttcgctccctctctaataagatcaaacagaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagcctgatgagaggacttagctccaggaaacggcgctctcatgatgttctgaccgtgcagtttttgatcctcggcatgctgctgatgacaggcggggtcactctcgtgcgaaagaacagatggttactgcttaatgtaacctcggaagacttgggaaagacattctcagttggtaccggcaactgcactacaaatattctggaagcgaaatactggtgtccggatagcatggaatataactgccccaatctaagtcctagggaagaaccggacgatatcgactgttggtgctacggggtggaaaacgtccgggtggcttatggaaagtgtgattccgccggccgttctcgcagaagcaggcgggcaattgacctccccacccacgaaaatcatggtctgaaaacgcgacaggaaaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaaaggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccaaactatgaaaggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcagaccagggctgtgctatcaacttcggtaagagggaattgaaatgcggggatggaatattcatctttcgcgactccgatgactggctgaataagtactcatattaccccgaggatccagttaagctcgccagtattgtgaaagcgtctttcgaagagggcaagtgtggtctgaacagcgtagactccttagagcatgaaatgtggcggtcaagagccgacgagatcaatgctatttttgaagagaacgaagtggatatcagcgtcgtggttcaggaccctaaaaatgtgtaccaaaggggcacccaccccttctctcgaatacgcgatgggctgcagtatggatggaagacatggggcaaaaaccttgtcttttccccagggcggaagaatggaagtttcattatcgacggcaagagcagaaaagagtgccccttttctaacagggtgtggaactccttccagattgaggaatttggtactggggttttcaccacacgtgtgtacatggatgcagtctttgagtatactatcgactgtgatggatcaatattgggcgccgctgtaaacggtaagaaaagtgcccacggcagccctaccttctggatggggtcgcatgaagtgaatggaacgtggatgatccacacactcgaggcactggactacaaggaatgcgagtggccactaacccatactattggcacatccgttgaggaatctgagatgtttatgccgcgcagcatcgggggacccgtgtcaagtcacaaccacattcctggctataaagtccagaccaatggtccatggatgcaagtgcccctggaagtaaagcgggaggcgtgtcctgggacttccgtgatcatagatggaaactgcgacggcagaggcaagtctaccaggagcacaacggattccgggaaagtcattccagaatggtgctgtcgatcatgcaccatgcccccggttagcttccatggaagtgacggttgttggtaccctatggagatccggccacgcaagactcacgagtctcatctcgtgagatcctgggtgacagccggcgaaatccacgctgtccccttcgggctggtgagcatgatgattgccatggaggttgtacttaggaaacggcagggacctaagcagatgttggtgggcggtgtcgtgctgttaggggcaatgctcgttggacaagtgaccctgcttgatctgttgaaactcacagtcgctgtgggcctgcattttcacgaaatgaataacggcggggacgccatgtatatggcactaatcgccgctttctcgattcgacccggactgctcataggttttggcctgagaactctttggtcaccacgcgagaggttggtactgaccttaggggcggccatggtcgagatcgcactcggaggcgtgatgggtgggctgtggaagtaccttaacgctgtttctctgtgcattctaacgatcaatgccgtggccagtcgtaaggcttccaacacaattctccctctgatggcattgctgacccccgtcactatggccgaagtgcggttagcggctatgttcttttgtgccgttgtgatcataggagtcctccaccagaatttcaaagacaccagcatgcagaagacaatcccactggtggcacttactctgacctcttacttgggcctcacacagccgtttctgggcctatgcgccttcctggctacgagaatttttgggaggcgcagcatccctgtaaacgaggcacttgccgcggctggactcgtgggtgttctggccggcttggcattccaagaaatggagaattttctggggcccattgccgtcggaggcttactcatgatgctggtgtccgtggctggtcgagtcgatgggcttgaactgaaaaagttgggagaggtatcatgggaggaagaggccgaaatcagtggcagctctgcaagatatgacgtggctctctccgagcagggcgagttcaaactgctatcagaggagaaggttccatgggatcaggtggtcatgaccagtctggcccttgtgggggcggccctccatcccttcgcactgttgttagttctggctggatggctctttcacgtgcggggtgccaggcgcagcggcgacgtcctgtgggatatacctactccaaaaattatcgaagagtgtgaacatcttgaggacgggatctacggaattttccagtccacatttctgggcgcttctcaacgtggtgtgggggtagcacagggaggcgtgttccacaccatgtggcatgttactagaggcgcctttttggtccggaacgggaagaagctaataccctcgtgggccagcgtgaaagaagatctggtggcttatggaggttcatggaagctcgagggaaggtgggacggggaggaagaggtccagctgatcgcggcagttcctggcaagaatgtggtaaacgtgcagacaaagccgtcccttttcaaagtccgcaatggcggtgaaattggggccgtggctttagattacccaagtggcacctctggaagccccatcgttaaccgaaatggcgaggtgattgggctgtatggaaacggtatcctcgtcggcgacaattcctttgtatcagccatatctcaaacggaggtgaaggaagaggggaaggaagagttgcaggaaatccctactatgctgaaaaagggaatgaccacagttctcgatttccacccaggcgcaggtaaaaccagacggtttctgccccagattcttgccgagtgcgctaggcgcagactgaggactttggtgctagcgcctacacgggtcgtgctgagcgagatgaaggaagccttccacgggctcgacgtcaaatttcatacccaagcattcagtgctcacggctccggacgtgaggtgatcgacgccatgtgtcatgcaacattaacttaccgcatgctggaaccgacccgagttgtgaactgggaggtaattatcatggatgaagcccactttcttgaccccgctagcatagccgcgagaggctgggcagcccacagggctcgggccaatgagtctgctacgattctgatgacagcaaccccacctgggacttcagatgagttcccccattccaacggagaaatcgaggacgtgcagaccgatatcccaagtgaaccttggaacacaggtcacgactggattctcgccgataagcgccccactgcttggttcttgccaagcatcagagccgcaaatgtcatggcggcctcgctgaggaaggctggcaaatctgttgtggtcctcaaccggaagacctttgagcgagaatatccgacgataaaacagaagaaacctgacttcattctggccacagatatcgcagagatgggggctaatctttgcgtggagagagtactagactgtcgcaccgcctttaagcccgtgctggttgatgaaggaaggaaggtggcaattaaaggcccattgcggatctccgccagctcagctgcgcagcgtagaggtaggatagggcgcaaccccaatcgggacggcgatagttactactattctgagcctacttccgaaaacaatgcccatcacgtctgctggttagaggcaagcatgctgctcgacaacatggaggtgcgaggaggcatggtcgctccactgtacggggtggaaggaacaaagacccccgtttcacctggcgagatgagacttagggacgatcaacgcaaagtattccgggaactggtgagaaattgcgacctcccggtctggttgagttggcaagtggccaaggccggtctgaaaactaacgatcgtaagtggtgttttgaggggccagaagaacatgagattctaaatgacagcggagaaacagttaagtgcagggcacccggcggtgctaaaaagcctctgcggccccgctggtgtgatgagcgagtgtcctctgaccagagcgccctctccgagttcatcaaatttgcggagggcagaagaggggctgccgaagtccttgtggtactgtcagagttaccagatttcttggcaaagaaaggaggcgaggccatggacaccatctctgtgtttctgcacagtgaagaggggtcgcgggcttatcgcaacgcactcagcatgatgcctgaagccatgacgattgttatgctgttcatccttgcgggactgctcacttccggcatggtcatatttttcatgtctcccaagggtatatcaagaatgagcatggctatggggaccatggccggatgcggctacttgatgtttctgggtggcgtgaaaccaacacacatctcctatgtgatgttaattttcttcgtcctaatggttgtggtaatccctgagccggggcagcaaaggagtatccaggataatcaggtggcatacctgattataggaatcctcacccttgtctctgccgtggctgccaacgaactgggcatgttggagaagacaaaggaggacctgtttgggaaaaagaatctcattcccagctcagcatccccatggagttggcctgatctggaccttaaacccggagctgcctggactgtttatgtgggcatcgtcaccatgctcagcccaatgctgcatcactggattaaggtggaatacggtaacttgtctctgtccgggatcgcgcagtcagccagcgtattatcgttcatggataaaggaataccttttatgaagatgaatatctctgttattatgctactggtgagtggctggaactccatcacggtcatgcccctcctttgtggcattgggtgcgcaatgctgcattggagcttgatcctgccgggaataaaggctcaacagtcaaaactcgcccagcgacgggtgttccacggtgtggcagagaacccagtcgttgacggcaatcctacagtggacattgaagaggctcccgagatgccagccctgtacgaaaagaaacttgccttatatctgctcttggcgctgtccctagcttctgtagcaatgtgtcgtactccctttagcctggccgaggggatcgtgctcgctagtgccgcacttggacctctgattgaaggcaacacctccttgctgtggaatggtccgatggccgtcagcatgacaggggtgatgagaggaaaccactacgctttcgttggcgtgatgtataatctctggaagatgaaaaccggccgcagggggtctgcgaacggaaagactctgggtgaggtctggaagcgggaattaaatcttctggataaaagacagtttgagctctacaagcgcaccgacatcgtggaggtagatagggacacagcccgacggcatctagcagaaggcaaagttgatacgggggtggctgtctcaagaggaactgccaagctgaggtggttccacgagcgcggctatgtgaaattggaaggtcgtgttatagacctggggtgcggacggggcggctggtgttactatgcagccgctcaaaaggaggtgagtggggtcaagggatttaccctcggtagagatggccatgaaaaacccatgaacgtgcagtcccttgggtggaatatcattacattcaaggacaaaaccgatatccacaggctggagccagtaaagtgcgacactttgctgtgtgatattggagagagttcttcgtcaagcgtgacagaaggcgagcgcaccgtccgagttctcgacacggtggaaaaatggttagcctgcggtgtcgacaacttttgcgtgaaggtactggcgccttacatgcccgatgtgcttgagaaactggaactactccagcggagattcgggggaactgttatcaggaatcctctgtcccgcaacagtacacatgagatgtactatgtgtctggcgcaagaagcaatgtcacctttaccgtgaaccaaacttcccggttgctgatgaggcgtatgcgacgcccaacaggcaaggttaccctcgaggccgacgtcatacttcccattgggacaagatcagtggaaactgataagggacctctggacaaagaggctatcgaggaacgggtggagaggatcaagagtgaatacatgacgtcttggttctatgataatgacaacccataccgcacctggcactattgtggtagctacgtaacaaaaacttccggctcagccgcaagcatggtcaacggggtgattaagatcttaacctatccctgggatagaatagaggaagttacacggatggctatgaccgacactacgccgttcggacagcagagggtgtttaaagagaaggtcgatacccgagccaaggaccctccagctggcacacgtaaaattatgaaggtggttaatagatggctgttccgccacttggcccgggagaagaatcccaggctctgcactaaggaggagtttatcgcaaaagtgagatctcatgcggccattggtgcttacctggaagaacaggaacaatggaagaccgccaatgaggcagtacaggatcctaagttctgggagctagtcgacgaggagcgcaaacttcaccagcaggggcggtgtaggacatgcgtgtacaacatgatgggaaagcgagagaaaaagctgtccgagtttggcaaagctaagggcagtagagccatctggtatatgtggctcggggcacggtacctggagttcgaggccttgggatttctgaatgaagatcattgggcgagcagggagaactcgggtggcggggtggagggaataggcctccaatatcttggttacgttatccgcgacctggctgccatggacgggggaggcttctatgcagatgacaccgccggctgggatactcgtattacagaagctgacttagatgacgagcaggaaatcctgaattacatgtccccacaccacaagaaattggcccaggcagtcatggagatgacgtataagaacaaagtggtaaaggtgctcagacccgctccagggggaaaagcctacatggatgtcatttctcgaagggaccagcggggttcaggccaagtggttacctacgcgctgaatactatcacaaacctaaaggtgcagcttattcgcatggctgaggccgaaatggtcatccatcaccagcatgtgcaagattgtgacgagagcgttctgaccagactcgaagcatggctgaccgagcacgggtgcgataggttgaaacggatggccgtgagtggagacgactgtgtagtccgccctatagatgacagatttggcttagctctgtcccatctcaatgcaatgtctaaggtgcgaaaggatattagcgaatggcagccctcaaaaggttggaacgactgggagaatgttccattctgctcccaccactttcatgagcttcagctgaaggatgggaggcggatcgtggtcccttgtcgtgaacaggacgagctaatcggccgcggaagagtgagtcccggcaacgggtggatgattaaagaaacagcctgcctgagcaaggcgtatgccaatatgtggtctctcatgtacttccacaaaagggatatgcggttgctgtcacttgctgtatccagcgcagtgccaacttcttgggtcccccaaggaagaacgacctggagtatacatggtaagggcgagtggatgacaactgaagacatgctggaggtttggaaccgcgtgtggatcaccaacaatcctcacatgcaggataagacaatggtgaaaaagtggcgagacgtcccatatctcaccaaaaggcaggataagttatgtgggtcgctgattggaatgactaaccgggccacgtgggcttcccatatccacttggtgattcacagaatccgtacactgataggccaggagaaatacaccgactatctcactgttatggatcgctacagcgtagacgccgaccttcaactgggtgaactaatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 492 - RNA, 2719 nt, synthetic construct
  misc_feature 1..2719: note = mRNA product Design2 comprising derived and/or modified sequence from YFV 17D__NC_002031.1__C-prME (CDS opt3)
  source 1..2719: mol_type = other RNA
ggggcgctgcctacggaggtggcagccatctccttctcggcatcaagcttaccatgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgctctcatgatgttctgaccgtgcaatttttgatcctcggcatgctgctgatgacaggcggggtcactctcgtgcgaaagaacagatggttactgcttaatgtaacctcggaggacttgggaaagacattctcagttggtaccggcaactgcactacaaatattctggaagcgaaatactggtgtccggatagcatggagtataactgccccaatctaagtcctagggaagaaccagacgatatcgactgttggtgctacggggtggaaaacgtccgggtggcttatggaaagtgtgattccgccggccgttctcgcagaagcaggcgggcaatagacctccccacccacgagaatcatggtctgaaaacgcgacaggagaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaagggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccagactatgaagggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 493 - RNA, 3775 nt, synthetic construct
  misc_feature 1..3775: note = mRNA product Design2 comprising derived and/or modified sequence from YFV 17D__NC_002031.1__C-prME-NS1 (CDS opt3)
  source 1..3775: mol_type = other RNA
ggggcgctgcctacggaggtggcagccatctccttctcggcatcaagcttaccatgagcggcagaaaggcccaggggaaaaccctgggagtgaacatggtcaggcggggtgttcgctccctctctaataagatcaaacaaaagacaaaacagattggcaaccgacccgggccttcacgtggagtgcagggcttcatatttttctttcttttcaatatcctgactggtaagaagattacggctcacttgaaaagattatggaagatgctggacccaaggcaggggctagcagtactccggaaagtgaagcgcgtcgtggccagtctgatgagaggacttagctccaggaaacggcgctctcatgatgttctgaccgtgcaatttttgatcctcggcatgctgctgatgacaggcggggtcactctcgtgcgaaagaacagatggttactgcttaatgtaacctcggaggacttgggaaagacattctcagttggtaccggcaactgcactacaaatattctggaagcgaaatactggtgtccggatagcatggagtataactgccccaatctaagtcctagggaagaaccagacgatatcgactgttggtgctacggggtggaaaacgtccgggtggcttatggaaagtgtgattccgccggccgttctcgcagaagcaggcgggcaatagacctccccacccacgagaatcatggtctgaaaacgcgacaggagaagtggatgactgggcgcatgggagaaagacagcttcagaaaatcgagaggtggtttgtgcggaaccctttctttgccgtcaccgctctgacaattgcatacttggttggctccaatatgactcaacgcgtggtaatcgccctcctggtgttagctgtcggcccagcctattcagcgcactgcattgggatcaccgatagagacttcatagaaggagtgcatggtggcacatgggttagtgcaaccctggagcaggataagtgtgtgacggtcatggcccccgacaaacctagcctcgatatttctcttgagactgtggctatcgacaggccagccgaagtacgtaaggtttgctacaacgcagtgctgacacacgtcaagattaatgacaaatgtccgtccaccggggaggctcacttggccgaagagaacgaaggagataacgcgtgcaagcggacttattcagaccgaggctggggtaatgggtgtggcctatttggaaaaggcagcatcgtggcctgcgcaaagttcacatgcgctaaaagtatgtctctgtttgaggtcgatcagaccaagatccagtacgtgattagagcccaactccatgttggggctaagcaggagaactggaatacggacataaaaaccctgaagttcgatgccctttccggaagccaggaagtggagttcatcggttacggcaaagcaacactggaatgtcaagtacagactgccgtcgactttgggaactcgtatattgctgagatggaaaccgagtcttggatcgtggataggcagtgggcgcaggacttgacactcccctggcaatccggatcaggcggtgtttggcgcgagatgcaccatctggtggagttcgagcctccacacgcagccactatacgggtcttagctctggggaatcaggaaggcagtctaaagaccgccctcacaggagcaatgagagtgaccaaagatactaacgacaataacctgtacaaacttcacggcgggcatgtaagctgcagggtgaagttgtccgccctgacgctcaagggaacatcttataagatttgtaccgataaaatgtttttcgttaagaatcccactgacaccggtcacggcacagtcgtgatgcaagtgaaagtcagcaagggggctccttgccgcatcccagttatcgtggccgacgatctgaccgcagcgattaacaagggaatccttgtgactgtaaatcccattgcttcaacaaacgacgatgaggtcctgatagaagtgaatccgccttttggcgacagttacatcattgttggtcgaggggattcccggttgacgtatcagtggcataaagagggcagctctatcggaaaactcttcacccagactatgaagggcgtggagcgtctggccgtcatgggggacacagcatgggatttttcaagtgccggaggcttctttaccagcgtgggtaaggggatccacacagttttcggatccgcttttcagggcttattcggtggcctgaactggattactaaagtgataatgggggccgtactaatctgggtcggaattaataccagaaacatgacgatgtctatgtcgatgatcctcgtgggcgtgattatgatgtttctgagccttggggtcggagcagaccagggctgtgctatcaacttcggtaagagggaattgaaatgcggggatggaatattcatctttcgcgactccgatgactggctgaataagtactcatattaccccgaggatccagttaagctcgccagtattgtgaaagcgtctttcgaagagggcaagtgtggtctgaacagcgtagactccttagagcatgaaatgtggcggtcaagagccgacgagatcaatgctatttttgaagagaacgaagtggatatcagcgtcgtggttcaggaccctaaaaatgtgtaccaaaggggcacccaccccttctctcgaatacgcgatgggctgcagtatggatggaagacatggggcaaaaaccttgtcttttccccagggcggaagaatggaagtttcattatcgacggcaagagcagaaaagagtgccccttttctaacagggtgtggaactccttccagattgaggaatttggtactggggttttcaccacacgtgtgtacatggatgcagtctttgagtatactatcgactgtgatggatcaatattgggcgccgctgtaaatggtaagaaaagtgcccacggcagccctaccttctggatggggtcgcatgaagtgaatggaacgtggatgatccacacactcgaggcactggactacaaggaatgcgagtggccactaacccatactattggcacatccgttgaggaatctgagatgtttatgccgcgcagcatcgggggacccgtgtcaagtcacaaccacattcctggctataaagtccagaccaatggtccatggatgcaagtgcccctggaagtaaagcgggaggcgtgtcctgggacttccgtgatcatagatggaaactgcgacggcagaggcaagtctaccaggagcacaacggattccgggaaagtcattccagaatggtgctgtcgatcatgcaccatgcccccggttagcttccatggaagtgacggttgttggtaccctatggagatccggccacgcaagactcacgagtctcatctcgtgagatcctgggtgacagcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 494 - RNA, 2476 nt, synthetic construct
  misc_feature 1..2476: note = mRNA product Design2 comprising derived and/or modified sequence from YFV 17D__NC_002031.1__X-SS-prME-XX (CDS opt3)
  source 1..2476: mol_type = other RNA
ggggcgctgcctacggaggtggcagccatctccttctcggcatcaagcttaccatgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaacaccgatatcaaaactctgaagtttgacgcattatccggctcacaggaagtagagttcattgggtacggaaaagctacactggaatgtcaggttcagaccgccgtggattttggcaacagctatatcgctgagatggaaacggagagttggatcgtcgacagacaatgggcccaggatctcacccttccttggcagtctggttccgggggcgtgtggagggagatgcatcacctggtcgaatttgagccaccgcatgcagccacaattcgggtgttggctctaggaaatcaagaaggcagcctgaagactgcgctcaccggggcaatgcgcgttacaaaggacactaacgataataacctgtacaaacttcacggaggtcacgtgtcgtgcagagtaaagctgtctgccttgaccctcaaaggcacatcctataagatatgtaccgacaaaatgtttttcgtcaagaatcccactgatacggggcatggaacagtggttatgcaagtgaaggtctcaaaaggcgctccttgcaggatcccagtgattgtagccgacgacctgaccgcagccatcaacaagggtatattagtgactgttaatcccattgctagtaccaacgatgacgaggtcctgatcgaagtgaatcctccattcggggatagctacatcattgtgggccgtggagactcccggctaacatatcagtggcacaaagagggctctagcatcgggaagctctttacccagactatgaaaggagtcgagcgactggccgttatgggtgatacagcatgggacttctcaagtgcgggcgggtttttcacgtccgtgggaaagggcattcataccgtgtttggtagcgctttccaggggctttttggcggattgaactggataactaaggtaatcatgggcgccgtcctgatttgggtggggatcaatacaagaaacatgaccatgtctatgtcaatgatcctcgttggagtgattatgatgttcctgagtcttggcgtcggtgcagatcaggggtgtgccataaattttggaaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 495 - RNA, 1966 nt, synthetic construct
  misc_feature 1..1966: note = mRNA product Design2 comprising derived and/or modified sequence from YFV 17D__NC_002031.1__X-SS-E (CDS opt3)
  source 1..1966: mol_type = other RNA
ggggcgctgcctacggaggtggcagccatctccttctcggcatcaagcttaccatgagaggcctgagctccaggaagcggcgctctcacgacgtgctcaccgtccagttccttatcctggggatgttgttaatgacaggaggtgttactctggtggcccattgcattggcataacggatcgagactttatcgagggggtacacggaggcacctgggtgtcagctacactagaacaagataaatgtgtcactgtgatggcacccgacaagcctagtctcgatattagcctggagaccgttgccatcgaccgtccagcggaagtgagaaaagtctgctacaacgctgtgcttacacatgtaaagattaatgataaatgtccgtccaccggtgaggcccacctggcagaagagaacgagggggacaatgcctgcaagaggacttattctgatcggggatggggcaacggctgtgggttgttcggaaagggttcgatcgttgcttgcgcaaaatttacatgtgccaagtcaatgagcctcttcgaagtggaccagaccaaaatacagtacgtcatccgcgctcagctgcatgtgggcgccaagcaagagaattggaacacggatattaaaactctgaagtttgacgcgctcagtgggtcccaggaagtggagttcatcggatatggcaaggcaaccttagagtgccaggtccagacagccgttgattttggtaattcttacattgctgaaatggagactgaaagctggatcgtggacagacaatgggcccaggacctgacccttccctggcagtccgggtcaggaggcgtatggagggagatgcaccacttggtggagttcgaacctccacatgcagctacaatacgggtcctggccctaggcaaccaggaggggagtctcaaaaccgcgctgacgggagccatgcgcgtgactaaggatacaaatgacaacaatctttataaactgcacggtggccatgttagctgtcgagtgaagttgtctgcactcaccctgaaagggacttcctacaagatttgcacagataaaatgtttttcgtcaagaaccccaccgacacgggacacggcaccgtggtaatgcaagttaaggtgtcaaaaggtgctccttgtagaatcccagtcattgtggccgatgacttaacagctgccatcaataaggggatcctggtcactgtgaaccccattgcaagcaccaatgatgacgaagttctcatagaggtgaaccctccatttggcgatagttatatcattgtaggaaggggcgactctcggcttacataccagtggcacaaagaagggtccagcatcggaaagctgttcactcagaccatgaaaggtgtcgagcgtttggccgtgatgggcgatacagcttgggacttttcgtctgcagggggattcttcacctccgttggcaagggtatacatactgtgtttgggtcagcgttccaaggcctatttggaggcctgaactggattacgaaggtcatcatgggggccgtgctcatctgggtaggaattaatacacgcaacatgaccatgagtatgagcatgatcctggtgggtgttattatgatgttcctttccctgggcgtcggggcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 496 - RNA, 1996 nt, synthetic construct
  misc_feature 1..1996: note = mRNA product Design2 comprising derived and/or modified sequence from YFV 17D__NC_002031.1__X-SS-E-XX (CDS opt3)
  source 1..1996: mol_type = other RNA
ggggcgctgcctacggaggtggcagccatctccttctcggcatcaagcttaccatgagaggcctgagctccaggaagcggcgctctcacgacgtgctcaccgtccagttccttatcctggggatgttgttaatgacaggaggtgttactctggtggcccattgcattggcataacggatcgagactttatcgagggggtacacggaggcacctgggtgtcagctacactagaacaagataaatgtgtcactgtgatggcacccgacaagcctagtctcgatattagcctggagaccgttgccatcgaccgtccagcggaagtgagaaaagtctgctacaacgctgtgcttacacatgtaaagattaatgataaatgtccgtccaccggtgaggcccacctggcagaagagaacgagggggacaatgcctgcaagaggacttattctgatcggggatggggcaacggctgtgggttgttcggaaagggttcgatcgttgcttgcgcaaaatttacatgtgccaagtcaatgagcctcttcgaagtggaccagaccaaaatacagtacgtcatccgcgctcagctgcatgtgggcgccaagcaagagaattggaacacggatattaaaactctgaagtttgacgcgctcagtgggtcccaggaagtggagttcatcggatatggcaaggcaaccttagagtgccaggtccagacagccgttgattttggtaattcttacattgctgaaatggagactgaaagctggatcgtggacagacaatgggcccaggacctgacccttccctggcagtccgggtcaggaggcgtatggagggagatgcaccacttggtggagttcgaacctccacatgcagctacaatacgggtcctggccctaggcaaccaggaggggagtctcaaaaccgcgctgacgggagccatgcgcgtgactaaggatacaaatgacaacaatctttataaactgcacggtggccatgttagctgtcgagtgaagttgtctgcactcaccctgaaagggacttcctacaagatttgcacagataaaatgtttttcgtcaagaaccccaccgacacgggacacggcaccgtggtaatgcaagttaaggtgtcaaaaggtgctccttgtagaatcccagtcattgtggccgatgacttaacagctgccatcaataaggggatcctggtcactgtgaaccccattgcaagcaccaatgatgacgaagttctcatagaggtgaaccctccatttggcgatagttatatcattgtaggaaggggcgactctcggcttacataccagtggcacaaagaagggtccagcatcggaaagctgttcactcagaccatgaaaggtgtcgagcgtttggccgtgatgggcgatacagcttgggacttttcgtctgcagggggattcttcacctccgttggcaagggtatacatactgtgtttgggtcagcgttccaaggcctatttggaggcctgaactggattacgaaggtcatcatgggggccgtgctcatctgggtaggaattaatacacgcaacatgaccatgagtatgagcatgatcctggtgggtgttattatgatgttcctttccctgggcgtcggggctgaccagggatgcgccataaattttggcaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 497 - RNA, 2413 nt, synthetic construct
  misc_feature 1..2413: note = mRNA product Design2 comprising derived and/or modified sequence from YFV 17D__NC_002031.1__SS-prME (CDS opt3)
  source 1..2413: mol_type = other RNA
ggggcgctgcctacggaggtggcagccatctccttctcggcatcaagcttaccatggacgtgctgaccgtccagttcctcatccttggcatgctgttgatgacagggggagttactttagtgagaaagaacaggtggctgctactcaatgtaacgagcgaggatctgggtaaaaccttttccgtgggcacagggaactgcactaccaatattcttgaagccaagtactggtgtcccgactctatggagtataactgccctaatctgtcaccacgggaggaaccggatgacatagattgttggtgctacggagtcgaaaacgtgcgcgttgcttatggcaaatgtgacagtgcaggtcgaagccgtagatccaggcgggccatcgatttgcccacacacgagaatcatgggctcaagacccgccaagagaaatggatgactggaagaatgggcgaaaggcagctgcagaagattgagcggtggttcgtgcgcaaccctttcttcgcggtcacagctctgaccatcgcctacctcgtgggctctaatatgacgcagcgagtagttattgcattactggtgcttgccgtcgggccagcttattcggcacactgcatcggaataactgacagagattttatcgaaggtgtgcatggcgggacctgggtgtcagccacattggagcaagacaagtgtgtcactgttatggctcccgataaacctagcctggacattagtctagagaccgtggccatcgataggccagcggaagtacggaaggtgtgctacaacgcagtcctcacacacgtgaaaattaatgacaagtgtccctccaccggagaggcccatctggctgaagagaacgaaggcgacaatgcctgcaaacgtacgtattctgatcgcggttgggggaacggatgtggccttttcggcaaggggagcatcgttgcatgcgctaagtttacttgcgccaaatccatgtcactgttcgaggtggaccagacaaagatacagtacgtcattagagcgcagttgcacgtgggagccaaacaagagaattggaacaccgatatcaagactctcaaatttgacgcactgagtggtagccaggaagtagagttcattggctacgggaaggctacattagaatgtcaggttcagaccgccgtggattttggaaactcttatatcgctgagatggaaacggagtcctggatcgtcgacaggcaatgggcccaggatctgaccctcccttggcagtcaggcagcggtggggtgtggcgggagatgcaccatcttgtcgaatttgagccaccgcacgcagccacaattcgagtgctggctttgggcaatcaagaaggaagtctaaaaactgcgctgaccggcgcaatgcgcgttacaaaggacactaacgataataacctctacaagctgcatgggggacacgtgtcttgcagagtaaaactttccgccctgaccttgaagggtacaagctataaaatatgtaccgacaagatgtttttcgtcaaaaatcccactgatacgggccacgggacagtggttatgcaagtgaaggtctcgaagggagctccttgcaggatcccagtgattgtagccgacgacctcaccgcagccatcaacaaaggcatactggtgactgttaatcccattgcttctaccaacgatgacgaggtcttaatcgaagtgaatcctccattcggtgattcctacatcattgtggggcggggcgactcacgcctgacatatcagtggcataaggagggaagtagcatcggcaaactatttacccagactatgaagggggtcgagagactcgccgttatgggagatacagcatgggacttctcctctgcgggtggctttttcacgagcgtggggaaaggcattcacaccgtgtttggatcagctttccagggtctgtttgggggccttaactggataactaaggtaatcatgggagccgtcttgatttgggtgggcatcaatacaaggaacatgaccatgagtatgtccatgatcctggttggggtgattatgatgttcctcagcctgggagtcggcgcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 498 - RNA, 3469 nt, synthetic construct
  misc_feature 1..3469: note = mRNA product Design2 comprising derived and/or modified sequence from YFV 17D__NC_002031.1__SS-prME-NS1 (CDS opt3)
  source 1..3469: mol_type = other RNA
ggggcgctgcctacggaggtggcagccatctccttctcggcatcaagcttaccatggacgtgctgaccgtccagttcctcatccttggcatgctgttgatgacagggggagttactttagtgagaaagaacaggtggctgctactcaatgtaacgagcgaggatctgggtaaaaccttttccgtgggcacagggaactgcactaccaatattcttgaagccaagtactggtgtcccgactctatggagtataactgccctaatctgtcaccacgggaagaaccggatgacatagattgttggtgctacggagtcgaaaacgtgcgcgttgcttatggcaaatgtgacagtgcaggtcgaagccgtagatccaggcgggccatcgatttgcccacacacgagaatcatgggctcaagacccgccaagagaaatggatgactggaagaatgggcgaaaggcagctgcagaagattgagcggtggttcgtgcgcaaccctttcttcgcggtcacagctctgaccatcgcctacctcgtgggctctaatatgacgcagcgagtagttattgcattactggtgcttgccgtcgggccagcttattcggcacactgcatcggaataactgacagagattttatcgaaggtgtgcatggcgggacctgggtgtcagccacattggagcaagacaagtgtgtcactgttatggctcccgataaacctagcctggacattagtctagagaccgtggccatcgataggccagcggaagtacggaaggtgtgctacaacgcagtcctcacacacgtgaaaattaatgacaagtgtccctccaccggagaggcccatctggctgaagagaacgaaggcgacaatgcctgcaaacgtacgtattctgatcgcggttgggggaacggatgtggccttttcggcaaggggagcatcgttgcatgcgctaagtttacttgcgccaaatccatgtcactgttcgaggtggaccagacaaagatacagtacgtcattagagcgcagttgcacgtgggagccaaacaagagaattggaacaccgatatcaagactctcaaatttgacgcactgagtggtagccaggaagtagagttcattggctacgggaaggctacattagaatgtcaggttcagaccgccgtggattttggaaactcttatatcgctgagatggaaacggagtcctggatcgtcgacaggcaatgggcccaggatctgaccctcccttggcagtcaggcagcggtggggtgtggcgggagatgcaccatcttgtcgaatttgagccaccgcacgcagccacaattcgagtgctggctttgggcaatcaagaaggaagtctaaaaactgcgctgaccggcgcaatgcgcgttacaaaggacactaacgataataacctctacaagctgcatgggggacacgtgtcttgcagagtaaaactttccgccctgaccttgaagggtacaagctataaaatatgtaccgacaagatgtttttcgtcaaaaatcccactgatacgggccacgggacagtggttatgcaagtgaaggtctcgaagggagctccttgcaggatcccagtgattgtagccgacgacctcaccgcagccatcaacaaaggcatactggtgactgttaatcccattgcttctaccaacgatgacgaggtcttaatcgaagtgaatcctccattcggtgattcctacatcattgtggggcggggcgactcacgcctgacatatcagtggcataaggagggaagtagcatcggcaaactatttacccagactatgaagggggtcgagagactcgccgttatgggagatacagcatgggacttctcctctgcgggtggctttttcacgagcgtggggaaaggcattcacaccgtgtttggatcagctttccagggtctgtttgggggccttaactggataactaaggtaatcatgggagccgtcttgatttgggtgggcatcaatacaaggaacatgaccatgagtatgtccatgatcctggttggggtgattatgatgttcctcagcctgggagtcggcgcagatcagggttgtgccataaattttgggaagcgtgaacttaaatgcggagacggcatcttcatttttcgggattctgacgattggctgaacaagtactcatattaccccgaggacccggtgaaattggctagtatcgttaaggccagcttcgaagagggtaaatgtggcctcaattccgtggattctctggagcatgaaatgtggcgatcgagagcagacgagattaacgctatctttgaagagaacgaagtagacataagcgtcgtggtgcaggatcctaagaatgtctaccagagggggacacaccccttctcccgcatccgggacggattacaatatggctggaagacttgggggaaaaacctggttttctcaccaggaagaaagaatggcagttttattatcgatggtaaatctaggaaggagtgccctttcagcaaccgcgtgtggaactcctttcagattgaggagttcgggaccggagtatttacgacccgagtgtacatggacgccgtcttcgagtatacaatcgattgtgacggctcaatactaggtgcggccgtgaatggcaaaaagagcgctcatgggtctcccactttttggatgggatcccacgaagttaatggcacctggatgattcacacactcgaggcactggattacaaagaatgcgagtggccacttactcataccatcgggacgagtgtggaggaaagcgagatgttcatgccccggtctattggaggccctgtctcctcacacaaccatatcccaggttataaggtgcagacaaatgggccgtggatgcaggttcccttggaagtgaagcgtgaggcctgtcctggaaccagtgtcataatcgacggcaactgcgatggtagaggcaaaagcactaggtcgacaaccgactccgggaaggtaattccagaatggtgctgtcgctcttgcactatgccccctgtgagctttcacggatcagatggctgttggtacccaatggagatccggcccagaaaaacccacgagagtcatctggttaggtcctgggtgacagcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 499 - RNA, 10618 nt, synthetic construct
  misc_feature 1..10618: note = mRNA product Design2 comprising derived and/or modified sequence from YFV 17D__NC_002031.1__polyprotein (CDS opt4)
  source 1..10618: mol_type = other RNA
ggggcgctgcctacggaggtggcagccatctccttctcggcatcaagcttaccatgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgccggcgagatccacgccgtgcccttcggcctggtgagcatgatgatcgccatggaggtggtgctgagaaagagacagggccccaagcagatgctggtgggcggcgtggtgctgctgggcgccatgctggtgggccaggtgaccctgctggacctgctgaagctgaccgtggccgtgggcctgcacttccacgagatgaacaacggcggcgacgccatgtacatggccctgatcgccgccttcagcatcagacccggcctgctgatcggcttcggcctgagaaccctgtggagccccagagagagactggtgctgaccctgggcgccgccatggtggagatcgccctgggcggcgtgatgggcggcctgtggaagtacctgaacgccgtgagcctgtgcatcctgaccatcaacgccgtggccagcagaaaggccagcaacaccatcctgcccctgatggccctgctgacccccgtgaccatggccgaggtgagactggccgccatgttcttctgcgccgtggtgatcatcggcgtgctgcaccagaacttcaaggacaccagcatgcagaagaccatccccctggtggccctgaccctgaccagctacctgggcctgacccagcccttcctgggcctgtgcgccttcctggccaccagaatcttcggcagaagaagcatccccgtgaacgaggccctggccgccgccggcctggtgggcgtgctggccggcctggccttccaggagatggagaacttcctgggccccatcgccgtgggcggcctgctgatgatgctggtgagcgtggccggcagagtggacggcctggagctgaagaagctgggcgaggtgagctgggaggaggaggccgagatcagcggcagcagcgccagatacgacgtggccctgagcgagcagggcgagttcaagctgctgagcgaggagaaggtgccctgggaccaggtggtgatgaccagcctggccctggtgggcgccgccctgcaccccttcgccctgctgctggtgctggccggctggctgttccacgtgagaggcgccagaagaagcggcgacgtgctgtgggacatccccacccccaagatcatcgaggagtgcgagcacctggaggacggcatctacggcatcttccagagcaccttcctgggcgccagccagagaggcgtgggcgtggcccagggcggcgtgttccacaccatgtggcacgtgaccagaggcgccttcctggtgagaaacggcaagaagctgatccccagctgggccagcgtgaaggaggacctggtggcctacggcggcagctggaagctggagggcagatgggacggcgaggaggaggtgcagctgatcgccgccgtgcccggcaagaacgtggtgaacgtgcagaccaagcccagcctgttcaaggtgagaaacggcggcgagatcggcgccgtggccctggactaccccagcggcaccagcggcagccccatcgtgaacagaaacggcgaggtgatcggcctgtacggcaacggcatcctggtgggcgacaacagcttcgtgagcgccatcagccagaccgaggtgaaggaggagggcaaggaggagctgcaggagatccccaccatgctgaagaagggcatgaccaccgtgctggacttccaccccggcgccggcaagaccagaagattcctgccccagatcctggccgagtgcgccagaagaagactgagaaccctggtgctggcccccaccagagtggtgctgagcgagatgaaggaggccttccacggcctggacgtgaagttccacacccaggccttcagcgcccacggcagcggcagagaggtgatcgacgccatgtgccacgccaccctgacctacagaatgctggagcccaccagagtggtgaactgggaggtgatcatcatggacgaggcccacttcctggaccccgccagcatcgccgccagaggctgggccgcccacagagccagagccaacgagagcgccaccatcctgatgaccgccaccccccccggcaccagcgacgagttcccccacagcaacggcgagatcgaggacgtgcagaccgacatccccagcgagccctggaacaccggccacgactggatcctggccgacaagagacccaccgcctggttcctgcccagcatcagagccgccaacgtgatggccgccagcctgagaaaggccggcaagagcgtggtggtgctgaacagaaagaccttcgagagagagtaccccaccatcaagcagaagaagcccgacttcatcctggccaccgacatcgccgagatgggcgccaacctgtgcgtggagagagtgctggactgcagaaccgccttcaagcccgtgctggtggacgagggcagaaaggtggccatcaagggccccctgagaatcagcgccagcagcgccgcccagagaagaggcagaatcggcagaaaccccaacagagacggcgacagctactactacagcgagcccaccagcgagaacaacgcccaccacgtgtgctggctggaggccagcatgctgctggacaacatggaggtgagaggcggcatggtggcccccctgtacggcgtggagggcaccaagacccccgtgagccccggcgagatgagactgagagacgaccagagaaaggtgttcagagagctggtgagaaactgcgacctgcccgtgtggctgagctggcaggtggccaaggccggcctgaagaccaacgacagaaagtggtgcttcgagggccccgaggagcacgagatcctgaacgacagcggcgagaccgtgaagtgcagagcccccggcggcgccaagaagcccctgagacccagatggtgcgacgagagagtgagcagcgaccagagcgccctgagcgagttcatcaagttcgccgagggcagaagaggcgccgccgaggtgctggtggtgctgagcgagctgcccgacttcctggccaagaagggcggcgaggccatggacaccatcagcgtgttcctgcacagcgaggagggcagcagagcctacagaaacgccctgagcatgatgcccgaggccatgaccatcgtgatgctgttcatcctggccggcctgctgaccagcggcatggtgatcttcttcatgagccccaagggcatcagcagaatgagcatggccatgggcaccatggccggctgcggctacctgatgttcctgggcggcgtgaagcccacccacatcagctacgtgatgctgatcttcttcgtgctgatggtggtggtgatccccgagcccggccagcagagaagcatccaggacaaccaggtggcctacctgatcatcggcatcctgaccctggtgagcgccgtggccgccaacgagctgggcatgctggagaagaccaaggaggacctgttcggcaagaagaacctgatccccagcagcgccagcccctggagctggcccgacctggacctgaagcccggcgccgcctggaccgtgtacgtgggcatcgtgaccatgctgagccccatgctgcaccactggatcaaggtggagtacggcaacctgagcctgagcggcatcgcccagagcgccagcgtgctgagcttcatggacaagggcatccccttcatgaagatgaacatcagcgtgatcatgctgctggtgagcggctggaacagcatcaccgtgatgcccctgctgtgcggcatcggctgcgccatgctgcactggagcctgatcctgcccggcatcaaggcccagcagagcaagctggcccagagaagagtgttccacggcgtggccgagaaccccgtggtggacggcaaccccaccgtggacatcgaggaggcccccgagatgcccgccctgtacgagaagaagctggccctgtacctgctgctggccctgagcctggccagcgtggccatgtgcagaacccccttcagcctggccgagggcatcgtgctggccagcgccgccctgggccccctgatcgagggcaacaccagcctgctgtggaacggccccatggccgtgagcatgaccggcgtgatgagaggcaaccactacgccttcgtgggcgtgatgtacaacctgtggaagatgaagaccggcagaagaggcagcgccaacggcaagaccctgggcgaggtgtggaagagagagctgaacctgctggacaagagacagttcgagctgtacaagagaaccgacatcgtggaggtggacagagacaccgccagaagacacctggccgagggcaaggtggacaccggcgtggccgtgagcagaggcaccgccaagctgagatggttccacgagagaggctacgtgaagctggagggcagagtgatcgacctgggctgcggcagaggcggctggtgctactacgccgccgcccagaaggaggtgagcggcgtgaagggcttcaccctgggcagagacggccacgagaagcccatgaacgtgcagagcctgggctggaacatcatcaccttcaaggacaagaccgacatccacagactggagcccgtgaagtgcgacaccctgctgtgcgacatcggcgagagcagcagcagcagcgtgaccgagggcgagagaaccgtgagagtgctggacaccgtggagaagtggctggcctgcggcgtggacaacttctgcgtgaaggtgctggccccctacatgcccgacgtgctggagaagctggagctgctgcagagaagattcggcggcaccgtgatcagaaaccccctgagcagaaacagcacccacgagatgtactacgtgagcggcgccagaagcaacgtgaccttcaccgtgaaccagaccagcagactgctgatgagaagaatgagaagacccaccggcaaggtgaccctggaggccgacgtgatcctgcccatcggcaccagaagcgtggagaccgacaagggccccctggacaaggaggccatcgaggagagagtggagagaatcaagagcgagtacatgaccagctggttctacgacaacgacaacccctacagaacctggcactactgcggcagctacgtgaccaagaccagcggcagcgccgccagcatggtgaacggcgtgatcaagatcctgacctacccctgggacagaatcgaggaggtgaccagaatggccatgaccgacaccacccccttcggccagcagagagtgttcaaggagaaggtggacaccagagccaaggacccccccgccggcaccagaaagatcatgaaggtggtgaacagatggctgttcagacacctggccagagagaagaaccccagactgtgcaccaaggaggagttcatcgccaaggtgagaagccacgccgccatcggcgcctacctggaggagcaggagcagtggaagaccgccaacgaggccgtgcaggaccccaagttctgggagctggtggacgaggagagaaagctgcaccagcagggcagatgcagaacctgcgtgtacaacatgatgggcaagagagagaagaagctgagcgagttcggcaaggccaagggcagcagagccatctggtacatgtggctgggcgccagatacctggagttcgaggccctgggcttcctgaacgaggaccactgggccagcagagagaacagcggcggcggcgtggagggcatcggcctgcagtacctgggctacgtgatcagagacctggccgccatggacggcggcggcttctacgccgacgacaccgccggctgggacaccagaatcaccgaggccgacctggacgacgagcaggagatcctgaactacatgagcccccaccacaagaagctggcccaggccgtgatggagatgacctacaagaacaaggtggtgaaggtgctgagacccgcccccggcggcaaggcctacatggacgtgatcagcagaagagaccagagaggcagcggccaggtggtgacctacgccctgaacaccatcaccaacctgaaggtgcagctgatcagaatggccgaggccgagatggtgatccaccaccagcacgtgcaggactgcgacgagagcgtgctgaccagactggaggcctggctgaccgagcacggctgcgacagactgaagagaatggccgtgagcggcgacgactgcgtggtgagacccatcgacgacagattcggcctggccctgagccacctgaacgccatgagcaaggtgagaaaggacatcagcgagtggcagcccagcaagggctggaacgactgggagaacgtgcccttctgcagccaccacttccacgagctgcagctgaaggacggcagaagaatcgtggtgccctgcagagagcaggacgagctgatcggcagaggcagagtgagccccggcaacggctggatgatcaaggagaccgcctgcctgagcaaggcctacgccaacatgtggagcctgatgtacttccacaagagagacatgagactgctgagcctggccgtgagcagcgccgtgcccaccagctgggtgccccagggcagaaccacctggagcatccacggcaagggcgagtggatgaccaccgaggacatgctggaggtgtggaacagagtgtggatcaccaacaacccccacatgcaggacaagaccatggtgaagaagtggagagacgtgccctacctgaccaagagacaggacaagctgtgcggcagcctgatcggcatgaccaacagagccacctgggccagccacatccacctggtgatccacagaatcagaaccctgatcggccaggagaagtacaccgactacctgaccgtgatggacagatacagcgtggacgccgacctgcagctgggcgagctgatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 500 - RNA, 2719 nt, synthetic construct
  misc_feature 1..2719: note = mRNA product Design2 comprising derived and/or modified sequence from YFV 17D__NC_002031.1__C-prME (CDS opt4)
  source 1..2719: mol_type = other RNA
ggggcgctgcctacggaggtggcagccatctccttctcggcatcaagcttaccatgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 501 - RNA, 3775 nt, synthetic construct
  misc_feature 1..3775: note = mRNA product Design2 comprising derived and/or modified sequence from YFV 17D__NC_002031.1__C-prME-NS1 (CDS opt4)
  source 1..3775: mol_type = other RNA
ggggcgctgcctacggaggtggcagccatctccttctcggcatcaagcttaccatgagcggcagaaaggcccagggcaagaccctgggcgtgaacatggtgagaagaggcgtgagaagcctgagcaacaagatcaagcagaagaccaagcagatcggcaacagacccggccccagcagaggcgtgcagggcttcatcttcttcttcctgttcaacatcctgaccggcaagaagatcaccgcccacctgaagagactgtggaagatgctggaccccagacagggcctggccgtgctgagaaaggtgaagagagtggtggccagcctgatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 502 - RNA, 2476 nt, synthetic construct
  misc_feature 1..2476: note = mRNA product Design2 comprising derived and/or modified sequence from YFV 17D__NC_002031.1__X-SS-prME-XX (CDS opt4)
  source 1..2476: mol_type = other RNA
ggggcgctgcctacggaggtggcagccatctccttctcggcatcaagcttaccatgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 503 - RNA, 1966 nt, synthetic construct
  misc_feature 1..1966: note = mRNA product Design2 comprising derived and/or modified sequence from YFV 17D__NC_002031.1__X-SS-E (CDS opt4)
  source 1..1966: mol_type = other RNA
ggggcgctgcctacggaggtggcagccatctccttctcggcatcaagcttaccatgagaggcctgagcagcagaaagagaagaagccacgacgtgctgaccgtgcagttcctgatcctgggcatgctgctgatgaccggcggcgtgaccctggtggcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 504 - RNA, 1996 nt, synthetic construct
  misc_feature 1..1996: note = mRNA product Design2 comprising derived and/or modified sequence from YFV 17D__NC_002031.1__X-SS-E-XX (CDS opt4)
  source 1..1996: mol_type = other RNA
ggggcgctgcctacggaggtggcagccatctccttctcggcatcaagcttaccatgagaggcctgagcagcagaaagagaagaagccacgacgtgctgaccgtgcagttcctgatcctgggcatgctgctgatgaccggcggcgtgaccctggtggcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 505 - RNA, 2413 nt, synthetic construct
  misc_feature 1..2413: note = mRNA product Design2 comprising derived and/or modified sequence from YFV 17D__NC_002031.1__SS-prME (CDS opt4)
  source 1..2413: mol_type = other RNA
ggggcgctgcctacggaggtggcagccatctccttctcggcatcaagcttaccatggacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 506 - RNA, 3469 nt, synthetic construct
  misc_feature 1..3469: note = mRNA product Design2 comprising derived and/or modified sequence from YFV 17D__NC_002031.1__SS-prME-NS1 (CDS opt4)
  source 1..3469: mol_type = other RNA
ggggcgctgcctacggaggtggcagccatctccttctcggcatcaagcttaccatggacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaagagagagctgaagtgcggcgacggcatcttcatcttcagagacagcgacgactggctgaacaagtacagctactaccccgaggaccccgtgaagctggccagcatcgtgaaggccagcttcgaggagggcaagtgcggcctgaacagcgtggacagcctggagcacgagatgtggagaagcagagccgacgagatcaacgccatcttcgaggagaacgaggtggacatcagcgtggtggtgcaggaccccaagaacgtgtaccagagaggcacccaccccttcagcagaatcagagacggcctgcagtacggctggaagacctggggcaagaacctggtgttcagccccggcagaaagaacggcagcttcatcatcgacggcaagagcagaaaggagtgccccttcagcaacagagtgtggaacagcttccagatcgaggagttcggcaccggcgtgttcaccaccagagtgtacatggacgccgtgttcgagtacaccatcgactgcgacggcagcatcctgggcgccgccgtgaacggcaagaagagcgcccacggcagccccaccttctggatgggcagccacgaggtgaacggcacctggatgatccacaccctggaggccctggactacaaggagtgcgagtggcccctgacccacaccatcggcaccagcgtggaggagagcgagatgttcatgcccagaagcatcggcggccccgtgagcagccacaaccacatccccggctacaaggtgcagaccaacggcccctggatgcaggtgcccctggaggtgaagagagaggcctgccccggcaccagcgtgatcatcgacggcaactgcgacggcagaggcaagagcaccagaagcaccaccgacagcggcaaggtgatccccgagtggtgctgcagaagctgcaccatgccccccgtgagcttccacggcagcgacggctgctggtaccccatggagatcagacccagaaagacccacgagagccacctggtgagaagctgggtgaccgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 507 - RNA, 10618 nt, synthetic construct
  misc_feature 1..10618: note = mRNA product Design2 comprising derived and/or modified sequence from YFV 17D__NC_002031.1__polyprotein (CDS opt5)
  source 1..10618: mol_type = other RNA
ggggcgctgcctacggaggtggcagccatctccttctcggcatcaagcttaccatgagcggcagaaaggcccaggggaaaaccctcggagtgaacatggtgcggcgcggcgttagatccctctctaataagatcaaacaaaagacaaaacagattgggaaccggcccggacctagccgcggcgtgcaggggttcatcttcttctttctgttcaatattcttacgggaaagaagatcaccgctcacctgaaaagactctggaagatgctggacccgcggcagggccttgccgtgctgcgcaaagtgaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaagacctcgggaagacattcagcgtcggaaccggcaactgcacgaccaatatcctggaagctaaatactggtgtcccgattccatggaatataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgtttgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagagggatcttccattggaaaacttttcacacaaaccatgaaaggcgtggagagactggctgtcatgggggacacagcctgggattttagctccgcgggaggcttctttacctctgttgggaagggaatccacaccgtgttcggcagcgcctttcaggggctgttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggccgaccagggatgtgctatcaacttcggcaagagagaactgaaatgcggcgatgggattttcatctttcgggactccgatgactggctcaataagtacagctattaccccgaggatcctgtgaagctggcctctatcgttaaagcctccttcgaagagggaaagtgtggccttaacagcgtggactctctggagcatgaaatgtggcgctccagagctgacgagattaatgcgatctttgaagagaacgaagtcgatattagcgtggttgtgcaggaccccaaaaatgtctaccaacgggggacacaccctttctctcgcatcagagatggactccagtatggctggaagacctgggggaaaaacctggtgtttagccccggacggaagaatggctccttcattatcgacggcaagagccgcaaagagtgcccgttttctaacagagtgtggaactccttccagatcgaggaatttgggacaggagtcttcaccacgcgggtttacatggatgccgtgtttgagtatacaattgactgtgatggcagcatcctgggggctgccgtgaacggaaagaaatccgcccacggctctcctaccttctggatggggagccatgaagtcaatggaacctggatgattcacacacttgaggctctcgactacaaggaatgcgagtggcccctgacccatacaatcggcacgtccgtggaggaatctgagatgtttatgcctcgcagcattggcgggcccgtttcctctcacaaccacatccctggatataaagtgcagaccaatggcccctggatgcaagtcccgctggaagtgaagagagaggcctgtcctgggacaagcgttatcattgatggaaactgcgacggccgggggaagtccaccagaagcacaaccgattctggaaaagtgatccccgaatggtgctgtcgctcctgcacgatgccccctgtcagcttccatggctctgacggctgttggtacccgatggagattcggcccagaaagacccacgagtcccatctcgtgcgcagctgggtcacagcgggggaaatccacgctgtgcctttcggactggtttctatgatgattgccatggaggtggtccttcggaaaagacagggccccaagcagatgctggtcggcggggttgtgctcctgggggccatgctggtcgggcaagtgacccttctcgatctgctgaaactcacagtggctgttggactgcattttcacgaaatgaataacggcggcgacgccatgtatatggcgcttatcgctgccttctccattcgccctgggctgctcatcggatttggcctgcggaccctgtggagccccagagagcgccttgtcctgacactcggggccgctatggtggagatcgccctgggaggcgtgatgggaggcctctggaagtacctgaacgctgtctccctttgcattctgaccatcaatgccgtggcgagccggaaggcctctaacacgattctccctctgatggctctgcttacacccgttaccatggccgaagtgagactggctgccatgttcttttgtgccgtcgtgatcattggcgttctccaccagaatttcaaagacaccagcatgcagaagacaatcccgctggtggctctcaccctgacgtcctaccttggcctgacacagccttttctcgggctgtgcgcgttcctggccacccggatctttggacgcagatctattcccgtcaacgaggctcttgccgccgctggcctggtgggggttctcgccggactggcgttccaagaaatggagaattttctcggccctatcgctgtcgggggactgcttatgatgctggtcagcgtggccggccgggtggatggcctggaactcaaaaagctgggggaggtctcctgggaggaagaggccgaaatttctggaagctccgctcgctatgacgttgccctttctgagcagggcgagttcaaactgctcagcgaggagaaggtgccctgggatcaggtggtcatgacatccctggcgctcgtgggggctgccctgcatccgttcgcccttctgctggttctcgctggatggctgtttcacgtgagaggcgcccggagaagcggggacgtcctttgggatatccctacccccaaaattatcgaagagtgtgaacatctggaggacggcatctacggaattttccagtctacatttctcggcgcttcccaacgcggggtgggagttgcccagggcggggtgttccacaccatgtggcatgtcacgcggggagcgtttctggtgagaaacggcaagaagctcatccctagctgggcctctgtcaaagaagatctggtggcttatgggggctcctggaaacttgagggacgctgggacggcgaggaagaggttcagctgattgccgctgtgcccgggaaaaatgtggtcaacgttcagaccaagcccagcctgttcaaagtgcggaatggaggcgaaatcggggccgtggccctcgattacccttccggaacatctggcagcccgattgtcaacagaaatggggaggtgatcggcctgtatggaaacggcattcttgttggggacaattcctttgtgagcgctatctctcaaaccgaggtcaaggaagagggaaaggaagaactccaggaaatccccacaatgctcaaaaagggcatgaccacggtgctggatttccaccctggggcgggaaaaacacgccggtttctcccccagattctggccgagtgcgctagacgcagacttcggaccctggtcctggcccctacacgcgtggttctctccgagatgaaggaagccttccacggcctggacgtgaaatttcatacccaggctttcagcgcccacggctctgggagagaggtcatcgacgcgatgtgtcatgctacccttacataccggatgctggaacccacgcgcgtggttaactgggaggtgattatcatggatgaagcccactttctcgaccctgccagcattgctgccagaggatgggcggcccaccgggctagagccaatgagtccgctaccatcctgatgacagccaccccgcccggcacatctgatgagttccctcatagcaacggggaaatcgaggacgtccagaccgatattccctccgaaccttggaacacgggacacgactggatcctggctgataagcgccccacagcctggttcctcccgtctattcgggcggccaatgtgatggctgccagccttagaaaggctggcaaatccgtggttgtcctgaaccgcaagacctttgagcgggaatatcctaccatcaaacagaagaaacccgacttcattctggccacagatatcgccgagatgggggctaatctctgcgtggagagagtgctggactgtcggaccgcgtttaagcccgtccttgttgatgaaggacgcaaggtggccatcaaaggccctctgagaattagcgcttcttccgccgcccagcggcgcggcagaatcgggcggaaccccaatcgcgacggagatagctactactattccgagcctacatctgaaaacaatgctcatcacgtgtgctggctcgaggccagcatgctgctggacaacatggaggtcagaggcgggatggtggcgccgctctacggagttgaaggcacgaagacccccgtgtcccctggggagatgcggcttcgcgacgatcaaagaaaagtcttccgggaactggtgagaaattgcgacctgcccgtttggctctcttggcaagtggccaaggctggactgaaaacaaacgatcgcaagtggtgttttgagggccctgaagaacatgagattcttaatgacagcggcgaaaccgtcaagtgccgggcccccgggggagctaaaaagccgctgagacctcgctggtgtgatgagcgggtgtccagcgaccagtctgccctctccgagttcatcaaatttgcggagggcagacgcggggccgctgaagtgctggtcgttctgagcgagctccccgatttccttgccaagaaaggaggcgaggctatggacacaatttctgtgtttctgcactccgaagaggggagccgggcctatagaaacgctctgtctatgatgcctgaagccatgaccatcgtgatgctgttcattctggcgggacttctgacgagcggcatggtcatctttttcatgtcccccaagggcatctctcgcatgagcatggccatggggaccatggctggatgcggctacctcatgtttctcgggggagtgaaacctacacacatttcctatgttatgctgatcttcttcgtgctcatggtcgtggttattcccgagccgggccagcagcggagcatccaggataatcaggtggcctaccttattatcgggatcctgaccctggtctccgctgtggccgccaacgaactcggaatgctggagaagacaaaggaggacctttttggcaaaaagaatctgattccttctagcgcgtccccctggtcttggcccgatctcgacctgaaacctggcgctgcctggaccgtttatgtggggatcgtcacaatgctgagcccgatgctccatcactggattaaggtggaatacggaaacctttccctgtctggcatcgctcagagcgcctccgtcctgagcttcatggataaagggattccctttatgaagatgaatatctctgtgatcatgctcctggtttccggatggaacagcattacggtgatgcctcttctgtgtggcatcgggtgcgccatgctccattggtctctgattctgcccggaatcaaggctcaacagtccaaactcgcccagagacgcgtcttccacggcgtggcggagaaccctgtggttgacggcaatcccaccgtggacattgaagaggcccctgagatgccggctctttacgaaaagaaactggccctgtatctcctgcttgctctgagcctcgcctctgtcgcgatgtgtcggacacccttttccctggccgaggggatcgtgctggctagcgccgctctcggacctcttattgaaggcaacacctccctgctgtggaatgggcccatggccgttagcatgaccggagtgatgagaggcaaccactacgctttcgtcggggtgatgtataatctctggaagatgaaaacaggacgcagaggctctgccaacggcaagacgctgggggaggtctggaagcgggaacttaatctgctcgataaacgccagtttgagctgtacaagagaaccgacatcgtggaggttgatcgggacacagcgagacggcatctggccgaaggaaaagtggataccggcgtcgctgtgagccgcgggacagccaagctcagatggttccacgagcggggatatgttaaacttgaaggccgcgtgatcgacctggggtgcggcagaggaggctggtgttactatgctgccgcccaaaaggaggtctccggggtgaagggatttaccctgggccgggatgggcatgaaaaacctatgaacgtgcagtctctcggatggaatattatcacgttcaaggacaaaacagatattcaccgcctggagcccgttaagtgcgacacccttctgtgtgatatcggcgagagctcctctagctccgtcaccgaaggggagagaacagtgcgggtgctcgacaccgtcgaaaaatggctggcgtgcggcgtggacaacttttgcgttaaggtgctggctccgtacatgcctgatgtcctcgagaaacttgaactgctgcagcgcagattcggaggcacagtgattcggaatcccctctctcgcaacagcacccatgagatgtactatgtttccggggccagaagcaatgtgacgtttacagtcaaccaaacctctcggctgcttatgcgcagaatgcggagacccacaggaaaggtgaccctggaggccgacgttatcctccctatcggcacgcgctccgtggaaaccgataaggggcccctggacaaagaggctattgaggaacgggtcgagagaatcaagagcgaatacatgacatcttggttctatgataatgacaacccttaccgcacctggcactattgtggatcctacgtgacaaaaaccagcggctccgccgcttctatggtgaacggggtcattaagatcctgacatatccgtgggatcggattgaggaagttaccagaatggccatgacggacacaacccccttcggccagcagcgcgtgtttaaagagaaggtggatacccgggcgaaggaccctcccgccggaacaagaaaaatcatgaaggtcgtgaatcgctggctgttccggcacctggctagagagaagaatcctcgcctttgcaccaaggaggagtttatcgccaaagttcggagccatgctgccattggcgcgtacctggaagaacaggaacaatggaagacagccaatgaggctgtgcaggatcccaagttctgggaactcgtcgacgaggagagaaaactgcaccagcaggggcggtgtagaacgtgcgtgtacaacatgatgggaaagcgcgagaagaaactttccgagtttggcaaagccaaggggagccgggctatctggtatatgtggctgggagccagatacctcgagttcgaggctctgggctttctgaatgaagatcattgggcctctcgcgagaactccgggggcggagttgagggcattgggctccaatatctgggatacgtgatcagagaccttgcggccatggacggcgggggattctatgctgatgacaccgccggctgggatacacggattaccgaagccgacctggatgacgagcaggaaatcctcaattacatgagcccgcaccacaagaaactggctcaggccgtcatggagatgacatataagaacaaagtggtcaaggtgcttcgccctgcgcccggcgggaaggcttacatggatgttatttctagacgggaccagcgcggaagcggccaagtggtcacctacgccctgaatacgatcaccaacctcaaggtgcagctgatcagaatggccgaggctgaaatggttattcatcaccagcatgtgcaagattgtgacgagtccgtcctgacacggctcgaagcctggctgaccgagcacgggtgcgatcgccttaaaagaatggctgtgtctggagacgactgtgtggttcggcctatcgatgaccgctttggcctggccctcagccatctgaatgcgatgtccaaggtcagaaaggatatttctgaatggcagcccagcaaagggtggaacgactgggagaatgtgcctttctgctcccaccactttcatgagcttcagctgaaggatggacggcgcatcgtggtcccctgtagagaacaggacgagctcattggccggggcagagtgagcccggggaacggatggatgatcaaagaaacagcctgcctgtctaaggcttatgccaatatgtggtccctgatgtacttccacaaacgcgatatgcggctcctgagccttgctgtttcctctgccgtgcctaccagctgggtcccccaaggcagaacgacatggtccatccatgggaagggagagtggatgaccacagaagacatgctggaggtgtggaaccgcgtttggattaccaacaatccccacatgcaggataagaccatggtgaaaaagtggcgggacgtcccttatctcacaaaaagacaggataagctgtgtggctctcttatcgggatgacgaaccgcgcgacctgggccagccatattcacctggtgatccaccggattagaacactcatcggacaggagaaatacaccgactatctgacagtgatggatcgctactccgttgacgctgacctgcaactcggcgaactgatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 508 - RNA, 2719 nt, synthetic construct
  misc_feature 1..2719: note = mRNA product Design2 comprising derived and/or modified sequence from YFV 17D__NC_002031.1__C-prME (CDS opt5)
  source 1..2719: mol_type = other RNA
ggggcgctgcctacggaggtggcagccatctccttctcggcatcaagcttaccatgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaggacctcgggaagacattcagcgtcggaaccggcaactgcacgaccaatatcctggaagctaaatactggtgtcccgattccatggagtataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgttcgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagaggggtcttccattggaaaacttttcacacagaccatgaagggcgtggagagactggctgtcatgggggacacagcctgggattttagctccgcgggaggcttctttacctctgttgggaagggaatccacaccgtgttcggcagcgcctttcagggcctcttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 509 - RNA, 3775 nt, synthetic construct
  misc_feature 1..3775: note = mRNA product Design2 comprising derived and/or modified sequence from YFV 17D__NC_002031.1__C-prME-NS1 (CDS opt5)
  source 1..3775: mol_type = other RNA
ggggcgctgcctacggaggtggcagccatctccttctcggcatcaagcttaccatgagcggcagaaaggcccaggggaaaaccctgggagtgaacatggtccggcgcggcgttagatccctctctaataagatcaaacaaaagacaaaacagattgggaaccggcccggacctagccgcggcgtgcaggggttcatctttttctttctgttcaatattcttacgggaaagaagatcaccgctcacctgaaaagactctggaagatgctggacccgcggcagggccttgccgtgctgcgcaaagtcaagagagtggttgcgtccctcatgcggggcctgtctagccgcaaaagacggtcccatgatgtgctgacagtccaatttctcattctggggatgcttctgatgaccggaggcgtgacactcgttcgcaagaacagatggctgcttctgaatgtgacctctgaggacctcgggaagacattcagcgtcggaaccggcaactgcacgaccaatatcctggaagctaaatactggtgtcccgattccatggagtataactgccctaatctgagcccccgggaagaacctgacgatatcgactgttggtgctacggggtggaaaacgtgcgcgtcgcctatggaaagtgtgattctgccggcagatcccggagaagccgccgggctattgacctccccacacacgagaatcatggcctgaaaaccagacaggagaagtggatgacagggcgcatgggagaacggcagcttcagaaaatcgagagatggtttgttcgcaaccctttctttgccgtgaccgctctgacgattgcctacctcgtgggctctaatatgacacaacgggtcgtgatcgcgctgcttgttctggccgtggggccggcttattccgcccactgcattggaatcaccgatagagacttcattgaaggcgtccatgggggaacatgggtgagcgctaccctcgagcaggataagtgtgttaccgtgatggcccccgacaaaccttctctggatatctccctggagacagtcgcgatcgaccgccccgccgaagtgcggaaggtctgctacaacgctgtgctcacgcacgttaagattaatgacaaatgtcctagcaccggcgaggcccacctggctgaagagaacgaaggcgataacgcctgcaagagaacatattccgaccgcgggtggggaaatggctgtgggctttttggaaaaggctctatcgtggcctgcgctaagtttacctgcgcgaaaagcatgtccctgttcgaggtcgatcagacaaagattcagtacgtgatccgggcccaactccatgttggggctaagcaggagaactggaataccgacattaaaacgctgaagttcgatgcccttagcggctctcaggaagtggagttcatcggatacggcaaagccacactggaatgtcaagtccagaccgctgtggactttgggaactcctatatcgccgagatggaaaccgagagctggattgtggatagacagtgggcgcaggacctcacactgccctggcaatctggaagcggcggggtttggcgggagatgcaccatctggtcgagttcgagccgcctcacgctgccaccatccgcgtgctcgccctgggaaatcaggaaggctcccttaagacagctctgacgggggccatgagagtgaccaaagatacaaacgacaataacctctacaagctgcacggcggacatgtctcttgccgggtgaagctgagcgctcttaccctcaaaggcacatcctataagatttgtaccgataaaatgtttttcgttaagaatcccacggacaccgggcacggaacagtggtcatgcaagtgaaagttagcaagggcgccccttgcagaatccccgtgattgtcgcggacgatctgaccgccgctatcaacaaggggatcctggtgacagttaatcccattgcctctaccaacgacgatgaggtgctcatcgaagtcaatcctccgtttggagactcctacattatcgtgggccgcggggatagccggctgacgtatcagtggcataaagaggggtcttccattggaaaacttttcacacagaccatgaagggcgtggagagactggctgtcatgggggacacagcctgggattttagctccgcgggaggcttctttacctctgttgggaagggaatccacaccgtgttcggcagcgcctttcagggcctcttcggcggactgaactggattacaaaagtgatcatgggcgctgtcctgatctgggtggggattaatacgcgcaacatgaccatgtccatgtctatgatccttgttggagtgattatgatgtttctcagcctgggcgtcggggccgaccagggatgtgctatcaacttcggcaagagagaactgaaatgcggcgatgggattttcatctttcgggactccgatgactggctcaataagtacagctattaccccgaggatcctgtgaagctggcctctatcgttaaagcctccttcgaagagggaaagtgtggccttaacagcgtggactctctggagcatgaaatgtggcgctccagagctgacgagattaatgcgatctttgaagagaacgaagtcgatattagcgtggttgtgcaggaccccaaaaatgtctaccaacgggggacacaccctttctctcgcatcagagatggactccagtatggctggaagacctgggggaaaaacctggtgtttagccccggacggaagaatggctccttcattatcgacggcaagagccgcaaagagtgcccgttttctaacagagtgtggaactccttccagatcgaggaatttgggacaggagtcttcaccacgcgggtttacatggatgccgtgtttgagtatacaattgactgtgatggcagcatcctgggggctgccgtgaatggaaagaaatccgcccacggctctcctaccttctggatggggagccatgaagtcaatggaacctggatgattcacacacttgaggctctcgactacaaggaatgcgagtggcccctgacccatacaatcggcacgtccgtggaggaatctgagatgtttatgcctcgcagcattggcgggcccgtttcctctcacaaccacatccctggatataaagtgcagaccaatggcccctggatgcaagtcccgctggaagtgaagagagaggcctgtcctgggacaagcgttatcattgatggaaactgcgacggccgggggaagtccaccagaagcacaaccgattctggaaaagtgatccccgaatggtgctgtcgctcctgcacgatgccccctgtcagcttccatggctctgacggctgttggtacccgatggagattcggcccagaaagacccacgagtcccatctcgtgcgcagctgggtcacagcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 510 - RNA, 2476 nt, synthetic construct
  misc_feature 1..2476: note = mRNA product Design2 comprising derived and/or modified sequence from YFV 17D__NC_002031.1__X-SS-prME-XX (CDS opt5)
  source 1..2476: mol_type = other RNA
ggggcgctgcctacggaggtggcagccatctccttctcggcatcaagcttaccatgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaacaccgatatcaaaacacttaagtttgacgctctgagcggatcccaggaagtggagttcattggctacggcaaagcgaccctcgaatgtcaggtccagacagccgtggattttgggaactcttatatcgctgagatggaaaccgagagctggattgttgaccggcaatgggcccaggatctgacgctgccttggcagtccggaagcggcggggtgtggagagagatgcatcacctcgtcgagttcgagccccctcatgccgctacaatccgcgtgctggcccttggaaatcaagaaggctctctgaagaccgcgctcaccggggctatgcgggttacaaaggacaccaacgataataacctgtacaaacttcacggcggacacgtgtcctgcagagtcaagctgagcgccctcacactgaaaggcacgtcttataagatttgtaccgacaaaatgtttttcgtgaagaatcccacagataccgggcatggaacagtggttatgcaggtcaaggtgagcaaaggcgccccgtgccgcatccctgtgatcgtcgctgacgacctgaccgccgctattaacaaggggatcctcgtgacggttaatcccattgcctccaccaacgatgacgaggtgctgatcgaagtcaatcctcccttcggagattcttacattatcgtgggccggggagacagcagacttacatatcagtggcacaaagagggctccagcatcggaaagctgtttacccagacaatgaaaggcgttgagcgcctcgcggtgatgggggataccgcctgggacttctcttccgctggaggctttttcacgagcgtcgggaaggggattcatacagtgtttggctctgccttccaagggctgtttggcggactgaactggatcaccaaggttattatgggcgctgtgcttatctgggtcgggattaatacacggaacatgaccatgtccatgagcatgatcctcgtgggagtgattatgatgttcctgtccctgggcgtcggggccgatcagggatgtgcgatcaattttggcaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 511 - RNA, 1966 nt, synthetic construct
  misc_feature 1..1966: note = mRNA product Design2 comprising derived and/or modified sequence from YFV 17D__NC_002031.1__X-SS-E (CDS opt5)
  source 1..1966: mol_type = other RNA
ggggcgctgcctacggaggtggcagccatctccttctcggcatcaagcttaccatgagaggcctgagctcccggaagcgcagatctcacgacgtgctcaccgtccagttcctgatccttgggatgctgctcatgacaggaggcgttacgctggtggcccattgcattgggatcaccgatcgggactttattgagggagtgcacggcgggacatgggtcagcgctacccttgaacaagataaatgtgtgacagttatggcccccgacaagccttccctggatatctctctcgagaccgtggcgattgaccgcccggctgaagtcagaaaagtgtgctacaacgccgttctgacacatgtgaagatcaatgataaatgtcccagcaccggagaggcccacctggctgaagagaacgagggcgacaatgcctgcaagcggacgtattccgatcgcggctgggggaacggatgtggcctcttcgggaagggatctatcgtcgcttgcgccaaatttacctgtgccaagagcatgtccctgttcgaagtggaccagacaaaaattcagtacgtgatcagagcgcagcttcatgtcggcgctaagcaagagaattggaacaccgatattaaaacactgaagtttgacgccctcagcgggtctcaggaagttgagttcatcggatatggcaaggctaccctggagtgccaggtgcagacggccgtggattttggcaattcctacattgcggaaatggagacagaaagctggatcgtcgaccggcaatgggcccaggaccttaccctgccttggcagtctgggtccggaggcgtgtggcgcgagatgcaccacctcgttgagttcgaaccccctcatgctgccacaattagagtgctggctctggggaaccaggagggaagcctcaaaaccgccctgaccggcgccatgcgggtcacaaaggatacgaatgacaacaatctttataaactgcacgggggacatgtgtcttgtcgcgttaagctctccgctctgacccttaaaggcacaagctacaagatctgcaccgataaaatgtttttcgtgaagaaccccacagacaccggccacgggacggtcgtgatgcaagtcaaggtgtccaaaggagcgccttgtagaatcccggttattgtggccgatgacctgacagctgccatcaataagggcattctcgtcaccgtgaaccccatcgcctctaccaatgatgacgaagttctgattgaggtgaaccctccctttggggatagctatatcatcgtcggacggggcgactcccgcctgacataccagtggcacaaagaagggagctctattggcaaactcttcacccagacaatgaagggagtggagagactggctgtgatgggcgatacggcctgggacttttccagcgctgggggattcttcacctctgttggcaaggggatccatacagtctttggaagcgcgttccaaggcctttttgggggcctgaactggattaccaaggtgatcatgggagccgtgctcatttgggtcggcatcaatacacggaacatgaccatgtccatgtctatgatcctggtgggggttattatgatgttccttagcctgggagtgggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 512 - RNA, 1996 nt, synthetic construct
  misc_feature 1..1996: note = mRNA product Design2 comprising derived and/or modified sequence from YFV 17D__NC_002031.1__X-SS-E-XX (CDS opt5)
  source 1..1996: mol_type = other RNA
ggggcgctgcctacggaggtggcagccatctccttctcggcatcaagcttaccatgagaggcctgagctcccggaagcgcagatctcacgacgtgctcaccgtccagttcctgatccttgggatgctgctcatgacaggaggcgttacgctggtggcccattgcattgggatcaccgatcgggactttattgagggagtgcacggcgggacatgggtcagcgctacccttgaacaagataaatgtgtgacagttatggcccccgacaagccttccctggatatctctctcgagaccgtggcgattgaccgcccggctgaagtcagaaaagtgtgctacaacgccgttctgacacatgtgaagatcaatgataaatgtcccagcaccggagaggcccacctggctgaagagaacgagggcgacaatgcctgcaagcggacgtattccgatcgcggctgggggaacggatgtggcctcttcgggaagggatctatcgtcgcttgcgccaaatttacctgtgccaagagcatgtccctgttcgaagtggaccagacaaaaattcagtacgtgatcagagcgcagcttcatgtcggcgctaagcaagagaattggaacaccgatattaaaacactgaagtttgacgccctcagcgggtctcaggaagttgagttcatcggatatggcaaggctaccctggagtgccaggtgcagacggccgtggattttggcaattcctacattgcggaaatggagacagaaagctggatcgtcgaccggcaatgggcccaggaccttaccctgccttggcagtctgggtccggaggcgtgtggcgcgagatgcaccacctcgttgagttcgaaccccctcatgctgccacaattagagtgctggctctggggaaccaggagggaagcctcaaaaccgccctgaccggcgccatgcgggtcacaaaggatacgaatgacaacaatctttataaactgcacgggggacatgtgtcttgtcgcgttaagctctccgctctgacccttaaaggcacaagctacaagatctgcaccgataaaatgtttttcgtgaagaaccccacagacaccggccacgggacggtcgtgatgcaagtcaaggtgtccaaaggagcgccttgtagaatcccggttattgtggccgatgacctgacagctgccatcaataagggcattctcgtcaccgtgaaccccatcgcctctaccaatgatgacgaagttctgattgaggtgaaccctccctttggggatagctatatcatcgtcggacggggcgactcccgcctgacataccagtggcacaaagaagggagctctattggcaaactcttcacccagacaatgaagggagtggagagactggctgtgatgggcgatacggcctgggacttttccagcgctgggggattcttcacctctgttggcaaggggatccatacagtctttggaagcgcgttccaaggcctttttgggggcctgaactggattaccaaggtgatcatgggagccgtgctcatttgggtcggcatcaatacacggaacatgaccatgtccatgtctatgatcctggtgggggttattatgatgttccttagcctgggagtgggcgccgaccaggggtgcgctatcaattttggaaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 513 - RNA, 2413 nt, synthetic construct
  misc_feature 1..2413: note = mRNA product Design2 comprising derived and/or modified sequence from YFV 17D__NC_002031.1__SS-prME (CDS opt5)
  source 1..2413: mol_type = other RNA
ggggcgctgcctacggaggtggcagccatctccttctcggcatcaagcttaccatggacgtgctgaccgtccagttcctcatcctgggcatgcttctgatgacagggggagttacgctcgtgagaaagaaccggtggctgcttctgaatgtgaccagcgaggatctcggcaaaacattttccgtcgggaccggaaactgcacaaccaatattctggaagccaagtactggtgtcccgactctatggagtataactgccctaatctgagcccgcgcgaagaacccgatgacatcgattgttggtgctacggcgtggaaaacgttagagtggcttatgggaaatgtgactccgccggacggtctcgcagaagccggcgcgcgattgatctccctacacacgagaatcatggcctgaagaccagacaagagaaatggatgacgggccggatgggggaacgccagcttcagaagatcgagagatggttcgtccggaacccctttttcgctgtgaccgccctgacaattgcctacctcgttggatccaatatgacccagcgcgtggtcatcgctctgcttgtgctggccgtgggccctgcttattctgcccactgcatcgggattacagacagagattttatcgaaggagtccatggcgggacctgggttagcgcgacgctcgagcaagacaagtgtgtgacagtgatggcccccgataaaccttccctggacattagcctggagaccgtcgctatcgatcggccggccgaagtgcgcaaggtttgctacaacgctgtgctcacacacgtcaaaattaatgacaagtgtccctctaccggagaggcccatctggcggaagagaacgaaggcgacaatgcctgcaaaagaacctattccgatcggggctgggggaacggatgtggccttttcgggaagggaagcatcgtggcttgcgccaagtttacatgcgctaaatctatgtccctgttcgaggttgaccagacgaagattcagtacgtgatcagagcccagctccacgtcggcgccaaacaagagaattggaacaccgatatcaagacactgaaatttgacgctcttagcgggtctcaggaagtggagttcattggatacggcaaggcgaccctggaatgtcaggtccagacagccgtggattttggcaactcctatatcgctgagatggaaaccgagagctggattgttgaccgccaatgggcccaggatctcacgctgccttggcagtccgggtctggaggcgtgtggcgggagatgcaccatctggtcgagttcgagccccctcacgccgctacaatcagagtgctcgccctggggaatcaagaaggaagccttaaaaccgcgctgaccggcgctatgcgcgttacaaaggacaccaacgataataacctctacaagctgcatgggggccacgtgtcctgccgggtcaaacttagcgccctgacactcaagggaacgtcttataaaatttgtaccgacaagatgtttttcgtgaaaaatcccacagataccggccacgggacagtggttatgcaggtcaaggtgtccaagggagccccgtgcagaatccctgtgatcgtcgctgacgacctgaccgccgctattaacaaaggcatcctggtgacggttaatcccattgccagcaccaacgatgacgaggtgctcatcgaagtcaatcctcccttcggggattcttacattatcgtgggacgcggcgacagccggctgacatatcagtggcataaggaggggtcctctatcggcaaactttttacccagacaatgaagggagttgagagactggcggtgatgggcgataccgcctgggacttcagctccgctgggggatttttcacgagcgtcggcaaagggattcacacagtgtttggatctgccttccaaggcctctttgggggcctgaactggatcaccaaggttattatgggagctgtgctgatctgggtcggcattaatacacgcaacatgaccatgtccatgagcatgatccttgtgggggtgattatgatgttcctctctctgggagtcggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 514 - RNA, 3469 nt, synthetic construct
  misc_feature 1..3469: note = mRNA product Design2 comprising derived and/or modified sequence from YFV 17D__NC_002031.1__SS-prME-NS1 (CDS opt5)
  source 1..3469: mol_type = other RNA
ggggcgctgcctacggaggtggcagccatctccttctcggcatcaagcttaccatggacgtgctgaccgtccagttcctcatcctgggcatgcttctgatgacagggggagttacgctcgtgagaaagaaccggtggctgcttctgaatgtgaccagcgaggatctcggcaaaacattttccgtcgggaccggaaactgcacaaccaatattctggaagccaagtactggtgtcccgactctatggagtataactgccctaatctgagcccgcgcgaagaacccgatgacatcgattgttggtgctacggcgtggaaaacgttagagtggcttatgggaaatgtgactccgccggacggtctcgcagaagccggcgcgcgattgatctccctacacacgagaatcatggcctgaagaccagacaagagaaatggatgacgggccggatgggggaacgccagcttcagaagatcgagagatggttcgtccggaacccctttttcgctgtgaccgccctgacaattgcctacctcgttggatccaatatgacccagcgcgtggtcatcgctctgcttgtgctggccgtgggccctgcttattctgcccactgcatcgggattacagacagagattttatcgaaggagtccatggcgggacctgggttagcgcgacgctcgagcaagacaagtgtgtgacagtgatggcccccgataaaccttccctggacattagcctggagaccgtcgctatcgatcggccggccgaagtgcgcaaggtttgctacaacgctgtgctcacacacgtcaaaattaatgacaagtgtccctctaccggagaggcccatctggcggaagagaacgaaggcgacaatgcctgcaaaagaacctattccgatcggggctgggggaacggatgtggccttttcgggaagggaagcatcgtggcttgcgccaagtttacatgcgctaaatctatgtccctgttcgaggttgaccagacgaagattcagtacgtgatcagagcccagctccacgtcggcgccaaacaagagaattggaacaccgatatcaagacactgaaatttgacgctcttagcgggtctcaggaagtggagttcattggatacggcaaggcgaccctggaatgtcaggtccagacagccgtggattttggcaactcctatatcgctgagatggaaaccgagagctggattgttgaccgccaatgggcccaggatctcacgctgccttggcagtccgggtctggaggcgtgtggcgggagatgcaccatctggtcgagttcgagccccctcacgccgctacaatcagagtgctcgccctggggaatcaagaaggaagccttaaaaccgcgctgaccggcgctatgcgcgttacaaaggacaccaacgataataacctctacaagctgcatgggggccacgtgtcctgccgggtcaaacttagcgccctgacactcaagggaacgtcttataaaatttgtaccgacaagatgtttttcgtgaaaaatcccacagataccggccacgggacagtggttatgcaggtcaaggtgtccaagggagccccgtgcagaatccctgtgatcgtcgctgacgacctgaccgccgctattaacaaaggcatcctggtgacggttaatcccattgccagcaccaacgatgacgaggtgctcatcgaagtcaatcctcccttcggggattcttacattatcgtgggacgcggcgacagccggctgacatatcagtggcataaggaggggtcctctatcggcaaactttttacccagacaatgaagggagttgagagactggcggtgatgggcgataccgcctgggacttcagctccgctgggggatttttcacgagcgtcggcaaagggattcacacagtgtttggatctgccttccaaggcctctttgggggcctgaactggatcaccaaggttattatgggagctgtgctgatctgggtcggcattaatacacgcaacatgaccatgtccatgagcatgatccttgtgggggtgattatgatgttcctctctctgggagtcggcgccgatcaggggtgtgcgatcaattttggaaagcgggaactgaaatgcggcgacgggatcttcatttttagagattccgacgattggctcaacaagtacagctattaccccgaggaccctgttaaactggcctccatcgtgaaggcttctttcgaagagggcaaatgtggacttaatagcgtggattccctggagcatgaaatgtggcgctctcgggccgacgagattaacgctatctttgaagagaacgaagtcgacattagcgtggttgtgcaggatccgaagaatgtctaccagagaggcacccaccccttctcccggatccgcgacgggctccaatatggatggaagacatggggcaaaaacctggtgttcagccctgggagaaagaatggatcttttatcattgatggcaaatcccggaaggagtgccccttcagcaacagagtttggaactcttttcagatcgaggagttcggcacgggggtgtttaccacacgcgtctacatggacgccgtgttcgaatataccattgattgtgacggatccatcctgggcgccgctgttaatgggaaaaagagcgcgcatggatctcctacattttggatgggcagccacgaagtgaatgggacctggatgattcacacgcttgaggccctcgattacaaagaatgcgagtggcccctgacacataccatcggaacctccgtcgaggaaagcgagatgttcatgccgcggtctatcggcggccctgtgtccagccacaaccatattcccgggtataaggtgcagacaaatggaccttggatgcaggtccccctggaagttaagagagaggcttgtcctggcacctccgtgatcattgacgggaactgcgatggacgcggcaaatctacaagaagcacgaccgactccgggaaggtgatccccgaatggtgctgtcggtcttgcacaatgccgcctgtcagctttcacggatccgatggctgttggtaccccatggagattcgccccagaaaaacccacgagtctcatctcgtgcggagctgggttacagcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 515 - RNA, 10618 nt, synthetic construct
  misc_feature 1..10618: note = mRNA product Design2 comprising derived and/or modified sequence from YFV 17D__NC_002031.1__polyprotein (CDS opt6)
  source 1..10618: mol_type = other RNA
ggggcgctgcctacggaggtggcagccatctccttctcggcatcaagcttaccatgtcaggaagaaaagcacaaggaaaaaccttgggtgttaatatggtacgccgtggagtgagaagcctaagcaataaaattaaacagaaaactaaacaaattggaaacaggccggggcctagcagaggggtgcaaggttttatcttcttcttcttatttaatatcttgaccggtaagaaaataaccgcacatttaaaaaggttgtggaaaatgctagatccaaggcaaggtttagctgttttacgtaaagtcaaaagagtagtggcgagtctaatgcgtggattaagctctaggaaacgtcgatcacatgatgtgctaacagtccaattccttatcctaggtatgcttcttatgactggaggagttaccctggtaaggaaaaatcgatggttgttgctaaatgtaaccagcgaagaccttggaaaaacgttttcagtaggtacagggaactgcacaacgaatatactagaagcaaaatattggtgtcccgattctatggaatacaattgtccaaacctgtccccaagggaagaaccggatgatatagactgctggtgttacggagtggaaaacgttcgcgttgcgtatggaaaatgcgactctgctggaagaagcaggcgatcgcgtagagcaattgacctgccaacacatgaaaatcatggattaaaaacaagacaggaaaaatggatgacaggaaggatgggagaacgtcaattacagaaaatcgaacgatggtttgttcgaaatcctttctttgcagttacggcattaactatagcgtatttagtaggatcaaatatgactcaacgagtagtaatagctctattggtccttgcagttggaccagcctactcagcgcattgcataggaataacggaccgcgatttcatcgaaggagtgcatgggggaacttgggttagtgccactctagaacaagacaaatgtgtaaccgtaatggcgcccgacaaaccaagtcttgacatatcattggaaacagtagcaatcgatcgtccagcagaagtacgtaaagtttgctataatgcagtcctcactcacgtcaaaataaatgataaatgtccatcaacaggagaagcgcatctggctgaagaaaatgagggcgacaatgcttgcaaacgaacctatagtgatcgaggatggggtaatggctgcggtctttttggcaaagggtccatagtagcatgcgcgaaatttacatgtgctaaaagtatgagtctattcgaagttgaccaaacaaaaatccaatacgtaattcgagcccaattacacgtaggagctaaacaggaaaattggaacaccgatataaaaacgctcaaatttgatgcactatctggaagtcaagaagtcgaatttataggttacggtaaagcaacactagaatgtcaagttcagacagcagtcgacttcggaaattcttacatagccgaaatggaaacagaatcttggatcgtagatagacaatgggcacaggatctaaccttaccttggcaatcggggtcaggtggcgtttggcgagaaatgcaccatcttgtagagttcgaaccaccacacgctgctaccattcgagtattggccctaggaaaccaggaagggagtcttaagaccgcattaactggcgcaatgcgagtaacaaaggatactaatgataataacctttataaactacatggtgggcacgtatcatgtagagtgaaacttagtgcactcacactcaaaggaacgtcttataaaatttgcacagacaaaatgttctttgtgaaaaatcccacagacactggacatggtacagtagtaatgcaagtaaaagtatcaaaaggagccccatgcagaatacctgtaatagtagcagacgatcttacagcagccatcaataaaggtatactggtcactgtaaatccaatagcgagtacgaatgacgatgaagttttgatagaagtgaatccaccattcggcgactcatatattattgtgggtagaggagactcaagactaacttaccagtggcataaagaaggaagcagcataggaaagctgtttacgcaaactatgaaaggagtagaaaggttggcagtaatgggggataccgcttgggactttagttcagccggcggattcttcacgtcagtaggaaaaggcatacatacagtttttggatccgcctttcaaggactctttgggggcttaaactggataacgaaggtaataatgggagctgttttgatctgggtagggataaatacgcgcaacatgactatgagtatgagcatgatattagttggtgttataatgatgttcttaagccttggggtcggcgctgatcaaggttgtgctattaatttcggaaagagagaacttaagtgcggagatggaatatttatattcagagattcggacgactggctgaataaatactcatattaccccgaagaccctgtaaaactggccagcatcgtcaaagcgagctttgaagaaggtaaatgtggtcttaattcagtagactcgctcgaacacgaaatgtggcgatcacgagcagatgaaataaatgctatcttcgaagaaaatgaagtagatatcagcgttgttgtacaggatccgaagaatgtataccagcgagggacccatccattctctcgaatcagagatggtttacaatacggttggaaaacatggggcaaaaatctagtattcagcccgggaaggaaaaacggcagctttattatagacggcaaatcaaggaaagaatgccctttttctaatagagtatggaacagtttccaaatcgaagaatttggcacgggtgtatttacaacccgggtttatatggacgcagtttttgaatacacaatagactgcgacggttctatacttggtgcagcagtaaatggcaagaaaagcgcacacggatcccccacgttttggatgggatcgcatgaagtaaatggtacatggatgatccatacactagaggctttagattataaggaatgtgagtggcctcttacacacactataggaacatctgtagaggaaagcgagatgttcatgccccgcagtatcggagggccagtcagttcacataatcacatcccgggatataaagttcaaacaaatggaccatggatgcaagtaccactagaagtaaagcgagaggcttgtcccggtacgtctgtaattattgatggtaactgtgacggaaggggaaaatcaacaagaagtactaccgattccggaaaagtaattccagagtggtgctgtagatcgtgtacaatgccaccggtctcatttcacgggagtgatggatgttggtatccaatggaaatacgaccgagaaaaactcacgaaagtcacctagtgaggtcgtgggttacggctggcgaaatacacgctgtacctttcggacttgtctctatgatgatagcaatggaggtggtacttcgcaagcgccagggtcccaaacaaatgttagtaggtggcgtcgtgctattaggtgcaatgctagtcgggcaagttacactactggatttattgaaactcacagttgctgtaggtcttcatttccatgaaatgaataatggtggagacgctatgtacatggcactaattgctgctttctcaataaggcctggtttactaattggcttcggactcagaactctatggtcgccgagggagaggctggtcctaactctcggcgcggccatggtagagattgcactaggaggagttatgggcggactctggaaatatctgaatgctgtttcattgtgcattttaaccatcaatgctgtagcatcccggaaagccagtaatacaattctcccacttatggcattacttaccccggtaactatggccgaagtaagactggcagcaatgttcttttgtgcagtcgtaatcataggggttttacaccaaaattttaaggacacgtcaatgcaaaagacaatccctctagtcgctctaaccctaacatcttatctcggattaacgcaaccatttttaggtttatgtgcgttcttagcgaccagaatcttcggtagacgatcaattccagtcaatgaggctctggccgcggccggacttgtcggcgtattagcagggttagcattccaggaaatggaaaattttctaggtcctatcgccgtcggtgggctactaatgatgttagtaagcgttgcaggaagggtcgacggtttagagttgaagaaattaggggaagtatcttgggaagaagaggcggaaatatcaggatcttctgcaagatatgatgtcgctttatccgaacaaggcgagtttaaactacttagcgaagaaaaagttccatgggatcaagtagtaatgacgagccttgccttagtaggagcagctttacatccatttgcattactcttggtcttagcgggatggctgtttcacgtaagaggagcgagacgttcaggtgacgtactttgggacataccaactcccaaaatcatcgaagaatgcgaacacctggaagacggaatttacggaatattccaatcaacgtttttaggcgccagccaaaggggagtaggagtagcacaaggaggtgttttccacacaatgtggcatgttactagaggagcattccttgtgcgtaacggtaagaaattaattccgagctgggcaagcgtaaaagaagatctggttgcttacggaggatcatggaaacttgaagggcgatgggatggcgaagaggaagtgcaacttattgcagctgttcccggcaaaaatgtggtaaacgtgcaaaccaaaccttcgttatttaaagttcggaatggaggagaaataggagcagtcgccctcgattatccatcgggaacaagcggaagccctatagttaatcgaaatggagaagtcatagggctatatggaaatggtattttagtgggagataacagttttgtttcagcaattagccaaaccgaagttaaagaagaagggaaagaagaattacaggaaattcccactatgctcaagaaagggatgactacagtccttgactttcatccaggtgccgggaaaacacggcgctttttaccccaaatactcgcagaatgtgcgaggagacggttaaggacattggtgcttgcaccgactcgagtagtactaagcgaaatgaaagaggctttccacgggttagacgtcaaattccatacccaggcattttcggcacacggtagtggaagagaagtaattgatgccatgtgtcatgctacattaacctacaggatgttagaaccaacgcgcgtggtaaactgggaagttataattatggacgaagcgcactttttggacccagcttcgatcgcagcgagaggttgggcagcgcacagagctcgtgcaaacgagtcagccactattctaatgacagcaacacccccaggaacaagcgatgagttcccacattctaacggcgaaatagaagatgttcaaactgatataccctcggaaccatggaacacagggcatgattggattttggccgacaaacgacctacagcatggttcttaccgtcaattagagccgcaaacgtcatggcagccagcttgagaaaggctggtaaaagtgtggtcgtcctgaaccgcaagaccttcgagagagaatatcccaccattaaacaaaagaaacctgactttattcttgcgactgatatagcagaaatgggagccaacctctgcgtagaaagagttctagactgcaggacagcgtttaaacccgtgcttgttgatgaaggaaggaaagtagcaataaaaggaccactgcgaatctctgcttcctccgcagcacaaaggcgcggacgcatagggagaaaccctaatcgagacggagatagctattattatagtgaaccgacaagtgaaaacaatgcacaccatgtatgttggctcgaggctagtatgttattggacaatatggaagttagaggtggtatggttgcgccactgtacggagtagagggcacaaaaacacctgtatccccaggggaaatgagattgcgagacgaccaacggaaagtattcagagagctagtacgaaattgcgatcttccagtatggttaagttggcaagtcgctaaagcaggtctaaagaccaacgaccggaagtggtgttttgagggcccagaagaacatgaaatacttaatgacagcggtgaaacggtaaaatgccgtgcacctggtggagctaagaaaccactacgacccagatggtgtgatgaaagggtaagttccgatcagtctgccctgtctgaatttattaagtttgccgagggaagacggggagccgctgaagtattggtcgtattgtcggaattacctgactttttggcgaagaaaggaggagaagcgatggatacgatctctgtattcctacacagtgaagagggaagcagggcataccgcaacgcgttaagtatgatgcctgaagcaatgaccatagtaatgttatttatcttagctggtttactaacgagcggtatggtaatatttttcatgagcccaaaaggcataagcagaatgagcatggcaatgggaactatggcaggttgtggctatttaatgtttctaggtggcgttaaaccaacacatatctcttatgtaatgctaatattcttcgttctcatggtggttgtaataccggaaccaggccaacaaagatccatacaagataaccaagttgcatacctcatcatagggatattaacattggtatcagcagtagcggcaaatgaacttgggatgctggagaagacaaaagaagacctgtttggcaagaaaaatctaattccctcgtccgcatccccgtggagctggccagacttggacttaaaacccggtgctgcttggactgtgtatgtaggaattgtaacaatgttgtcccctatgttacatcattggataaaagttgaatatggtaacctaagtttatcagggattgctcaatccgcatctgttctctcatttatggataaggggataccatttatgaaaatgaacatatcggtaatcatgcttctcgttagcggttggaatagtataactgttatgccattattgtgtggcattggatgcgcaatgctccattggagcttaatacttcccggaataaaagcacaacaatctaaactggcgcagcgtcgagtattccatggcgtcgcagaaaatcctgtggttgacggaaacccgacggtggatatcgaagaagcaccggagatgcctgcactatacgagaagaaattagcactatatctgctacttgcactgagcctagcaagtgtggccatgtgtcggactccgtttagcctggcagagggaatcgtgttagctagcgcagcactcggtccacttatagaggggaatacgtcgcttctctggaatggacctatggctgtttccatgaccggcgtgatgagaggtaaccattacgcttttgtaggagtaatgtataacctttggaagatgaaaacggggcgccgtgggagtgcaaatggaaaaacactcggggaagtatggaaaagggagctgaatttactagataaacggcaattcgaactctacaaaagaacagacatagtagaagtagatagagatacagccagacgacatcttgcagaaggaaaagtagacacaggtgtagcagtgtcccgaggaacagcaaaacttcgctggtttcatgagcgaggttatgtcaaactagaaggacgggtgatagacctggggtgtggcaggggaggatggtgttattatgcagcggcacaaaaagaggttagtggagttaagggctttaccttggggcgagatggtcatgaaaagccaatgaatgtgcagtctttgggatggaacataataacattcaaagacaaaacagatattcacagattagaaccagtaaagtgtgatacattactatgtgatataggcgaaagtagctcatcgtcagtaacggaaggagaaagaacagtaagagtattagacacagttgaaaaatggctagcatgcggagtagataacttctgtgtcaaggtactcgcaccttacatgccagacgtactagaaaaactcgaactattacagcgaagatttggaggcaccgtcatacgtaacccacttagtagaaatagtacacatgagatgtactatgtttcaggcgctagatcaaatgtaacgtttacagtaaatcaaacatcgagactgcttatgcgacgaatgagaagacccaccggcaaagtcactttagaagcggacgtgattctacctattgggacccgatccgtagaaacagacaaaggtccattagacaaggaagctatcgaagagagagttgaacgcatcaagtcggaatacatgacatcttggttctatgataatgataatccctatcgtacttggcattactgtgggtcttatgtcacaaagacgagcggatctgcagctagtatggtaaacggggttataaagatattaacttatccgtgggatcgcatcgaagaagtcacgcgtatggctatgacggataccactccatttggacaacagagagtatttaaagaaaaagtagacacccgtgcaaaagatcctcctgctggcacgaggaaaataatgaaagtagtcaaccgatggctttttcgacatttggcacgcgagaaaaaccctaggttatgtacaaaagaagaatttattgccaaagtacgatcgcacgccgcaataggtgcatacctcgaggaacaagagcaatggaagactgcaaatgaggctgttcaagatccaaagttttgggagctcgtagatgaagagagaaaactacatcaacaaggcagatgtaggacatgtgtatacaacatgatggggaaacgtgaaaagaaactgagcgagttcggcaaagctaaaggtagcagggcgatatggtatatgtggctgggcgctagatatctagagttcgaagcactaggatttttgaatgaggaccactgggctagtcgagaaaattctgggggtggtgtggaaggaataggtttacaatatttaggctacgtaataagagatctcgcggctatggatggaggaggattttatgccgatgataccgctggatgggacacaagaataacagaagccgatcttgacgacgaacaagaaatcctcaattacatgagtcctcaccacaagaaacttgcacaagctgttatggaaatgacatacaaaaacaaggtagttaaagtccttcgaccagcacccggaggtaaagcatacatggacgtgatttcacggagagatcaacgtggctctgggcaagtagtgacttacgcactaaataccataaccaatttaaaggttcagctgattagaatggcagaagcagaaatggttattcaccatcaacacgttcaagattgcgatgaatctgtattgacgaggttggaggcttggttaacagaacatggttgtgatagattaaaaaggatggcagtatctggagatgattgtgttgtaaggccaatagatgatcgatttgggctagctttaagccatctgaacgctatgtcaaaagtccgaaaggatataagcgaatggcaaccatcaaaaggatggaatgactgggaaaacgtacctttttgttcacatcacttccatgagttacaactaaaagacggtcgacgaattgtcgtaccatgtagagagcaagacgaattaataggcagaggaagggtttcaccgggtaatggttggatgatcaaagaaacggcgtgtttatcaaaggcatacgctaatatgtggtctctaatgtatttccataaacgggacatgagattgctatctcttgcagtatcatcagccgtcccaacttcatgggtgccacaaggtaggacaacatggtcgattcatggaaaaggagagtggatgactacggaagatatgttagaagtatggaatagagtatggataactaacaatccacatatgcaggataagactatggtcaagaaatggcgtgatgttccgtaccttaccaaaaggcaggacaaactatgtggaagtttaataggaatgacaaatcgtgccacatgggcctcgcacattcacctggttattcatagaattagaactttaatagggcaagaaaagtacactgactatttgaccgtcatggacagatattccgtcgacgcagacctgcaactaggtgagttaatttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 516 - RNA, 2719 nt, synthetic construct
  misc_feature 1..2719: note = mRNA product Design2 comprising derived and/or modified sequence from YFV 17D__NC_002031.1__C-prME (CDS opt6)
  source 1..2719: mol_type = other RNA
ggggcgctgcctacggaggtggcagccatctccttctcggcatcaagcttaccatgagcggaaggaaagcacaaggaaaaacattgggagtaaatatggtacgtcggggagtaagatctttaagcaataaaataaaacagaaaacaaaacaaataggaaatagaccaggaccatcaagaggagtccaaggctttatattctttttcttatttaatattcttaccggaaagaaaataacagcacacctaaaaagattatggaaaatgctagatccaagacaaggtctagcagtcttaagaaaagtaaaaagagtagtagcgtccttaatgagaggacttagtagcagaaaaagaagaagccacgacgtattaaccgtacaattcctaatactagggatgctactaatgacaggaggtgtcactttagtgaggaaaaatagatggttattattaaacgttacaagtgaagatctcggaaaaacttttagcgtcggaacgggtaactgcacaacgaatatattagaagctaaatattggtgtccagactcaatggaatataattgtccaaatttaagtccacgagaggaacccgatgacatcgattgttggtgctacggcgtagaaaatgtaagagtagcatatggaaaatgcgattccgcaggcagatctagaagatcacgccgagcaatagatttaccaacacatgaaaaccatggattaaaaacgagacaagaaaaatggatgaccggaagaatgggagaaagacaattacagaaaatagaaagatggttcgtcagaaacccattctttgcggttacagcactaacaatagcatatctagtagggagtaacatgacacaaagagtcgttattgctttattggtacttgcagtaggtcccgcatattcagcacactgcattggaattacagatagagactttatagaaggggttcacgggggtacttgggtaagtgctaccctagaacaagataaatgtgtaacagtaatggcaccagacaaacctagtttagatattagcttagaaacggttgctatagatagaccagcagaagtaagaaaagtttgttacaatgcagttttaacacacgtaaaaataaacgacaaatgtccaagtaccggtgaagctcatttagcggaagaaaacgaaggcgataatgcgtgtaaaagaacatactcagatcgaggttggggtaacggatgtggtctattcggaaaaggatccattgtagcctgtgccaaatttacatgtgcaaaatcaatgagcttgtttgaagttgaccaaacaaaaattcaatatgttataagagctcaactacatgtaggcgcaaaacaagaaaattggaacactgatataaaaactcttaaatttgatgcgctaagcggaagtcaagaagtagaatttataggatatggaaaagcaacattggaatgtcaggtacaaaccgcagttgattttggcaatagttatatcgctgaaatggagactgaaagttggatagtagatagacagtgggctcaagacttgacactaccgtggcaatcaggatcaggaggtgtatggagagaaatgcatcatttagtagaatttgaaccaccacacgccgcaaccataagagtacttgcgttagggaaccaagaaggaagtctaaaaacagcactgacaggagcaatgagagtaacaaaagacacaaatgataacaatttatacaaattacatggaggacacgtatcctgcagagtaaaactaagcgctctaacattaaaaggaacgagttataaaatatgcactgacaaaatgtttttcgtcaaaaatcctacggacacagggcatggaacggtagtcatgcaagtaaaagttagtaaaggagctccatgtagaataccagtaatagtagcagacgacttaacagcggcaataaataaaggaatattggtaacagtaaatcccatagcatcaacaaatgatgatgaagtattaatagaagtaaatccaccatttggagattcatatataattgttggacgaggtgatagcagattaacttaccaatggcataaagaaggatcatcaataggaaaattgtttacgcaaaccatgaaaggagtagaaagattagcagtaatgggagacacagcatgggatttttcaagcgcagggggcttctttacaagtgtaggaaaaggaatacacactgtattcggtagtgcgttccaagggttattcggcgggttgaattggattacaaaagtaataatgggagccgtattaatatgggtaggaataaatacccgaaacatgacgatgtcaatgagtatgattcttgtaggagttataatgatgttcctaagtttaggagtaggtgcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 517 - RNA, 3775 nt, synthetic construct
  misc_feature 1..3775: note = mRNA product Design2 comprising derived and/or modified sequence from YFV 17D__NC_002031.1__C-prME-NS1 (CDS opt6)
  source 1..3775: mol_type = other RNA
ggggcgctgcctacggaggtggcagccatctccttctcggcatcaagcttaccatgtcgggaagaaaagcccaaggaaaaacactcggagtaaatatggtacgcagaggagtcaggtccctatcgaataaaattaaacagaaaaccaaacagatcggaaatcgaccaggacccagccggggcgtccaaggatttattttcttctttctatttaacatattaacaggcaagaaaatcaccgctcacttaaaaagactttggaaaatgcttgatccacgccagggattagccgtattaagaaaagtaaaaagagtagtagcaagtcttatgagaggattgagttcaagaaaaagacgatcacacgatgttctaactgtacaatttttaatcctgggaatgctattaatgacaggcggtgtaactctagtgcgtaaaaatagatggttattactaaatgtaacaagcgaagacctgggtaaaacgttttcagttggcacgggtaattgtaccactaatattctcgaagcaaaatactggtgcccagatagcatggaatacaattgcccaaatttatctccaagagaagaaccagatgacattgactgttggtgttatggtgtcgaaaacgtaagagtggcttatggaaaatgcgacagtgcgggtagaagtcgacgctcaaggcgagcaatagatctgcccactcacgagaatcatggattaaaaactcgacaagaaaaatggatgacagggagaatgggggaacgccaattgcagaaaatagaaagatggtttgtacgcaaccccttctttgccgtaacggcattaaccatagcatatctagtaggaagtaatatgacccaaagagtagtaattgcactcttagtattagcagtagggccagcttactccgcacactgtataggtataacagatagagacttcatagagggagtacatggaggtacatgggttagtgctacattagaacaagataaatgcgttacagtaatggcaccagacaaaccaagtctggacataagtctagaaacagtcgctatagatagacccgcagaagttagaaaagtttgttacaacgcagtattgacgcatgttaaaataaacgataaatgcccaagtaccggtgaggcacatcttgcagaagaaaatgaaggagataatgcttgcaaaagaacatactcagaccggggatggggaaatggttgtggtctatttggtaaaggatctatagtggcctgcgcgaaatttacatgtgcaaaatcaatgagccttttcgaagttgatcaaacaaaaattcaatatgtgatacgagcacaactacatgtaggagcaaaacaagaaaattggaatacagatataaaaacactaaaatttgacgcgttaagcggatcgcaagaagtggagttcataggctacggtaaagcaaccctagaatgccaagtccaaacagcagtagattttggaaattcatatatagcggaaatggaaacagaaagctggattgtcgatcgacaatgggctcaagacttaactctgccttggcaatcaggatcaggaggagtttggagagaaatgcatcacctagttgaatttgaacctccacatgcagcaacaataagagttctagcactaggaaatcaagaaggctcactcaaaacagcattaacaggagcaatgagagtaactaaagacacaaacgataacaacctatacaaacttcatggaggtcacgttagttgtagagttaaactatcagcgctgacgctaaaaggaacaagttataaaatttgtacagataaaatgttctttgttaaaaatccaacagacacaggtcatggaactgtcgttatgcaagtcaaagtatcaaaaggagctccatgtcggattccggttattgtggcagatgaccttactgccgctataaataaaggaattttggtaactgtaaatccaatagcatccactaatgacgatgaggtgctaatagaggtaaatcccccgtttggcgattcttacataatcgtcggaagaggagatagtagacttacgtaccaatggcataaagagggtagttccataggtaaattatttactcaaacaatgaaaggagtggaacgacttgcagtaatgggtgacacagcgtgggatttttcctcagcaggaggattctttacctcagtaggtaaaggtatacataccgtatttggttcagcctttcaaggactattcggaggtctaaattggataacaaaagtaatcatgggagcagttctcatctgggtgggcattaacacaagaaatatgactatgagtatgagtatgatattagtaggggtgattatgatgtttttatcacttggggtgggcgcagaccaaggatgtgcaataaacttcggaaaaagagaattaaaatgcggtgatggaattttcatattccgcgacagtgatgattggttgaataaatactcatattatcccgaagacccagtgaaacttgctagcatcgtaaaagcatcgtttgaagaaggaaaatgcggattaaattctgttgacagtttagaacatgagatgtggagatcaagagcggacgaaataaacgcaatatttgaagaaaatgaggtagatattagtgtagtagtacaagatcctaaaaatgtatatcaaagaggtacccacccattttcacgtattagagatggcttacaatatggatggaagacttggggaaagaatttagtattttcaccaggaaggaaaaacggtagctttataatagatggcaaatccagaaaggaatgcccattcagcaacagagtatggaacagttttcaaatagaagaatttggaacaggtgtatttacaaccagagtatatatggacgcagtgttcgaatatacaatagactgcgacggatcaatattaggagcagccgtaaatggaaagaaatcagcacacggaagtccaaccttttggatgggaagccacgaggtaaatggtacatggatgatacatacgctagaggctttagattataaagaatgcgaatggccactaacacacactatcggaacatctgtagaagaaagtgaaatgtttatgccaagaagtataggcggtccagttagtagccataatcatatacctggatataaagtacaaacgaatggaccatggatgcaagttccgttggaagtaaaaagagaagcatgccctggcacatcagtaataattgacggaaactgtgatggtcgagggaaaagtacaagaagtacaacagattcaggcaaagttataccagaatggtgttgtcgttcatgtacaatgccaccagtatcatttcatgggagtgacggatgttggtacccaatggaaataagaccaagaaaaacacatgaaagccatttagttcgatcatgggtgacagcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 518 - RNA, 2476 nt, synthetic construct
  misc_feature 1..2476: note = mRNA product Design2 comprising derived and/or modified sequence from YFV 17D__NC_002031.1__X-SS-prME-XX (CDS opt6)
  source 1..2476: mol_type = other RNA
ggggcgctgcctacggaggtggcagccatctccttctcggcatcaagcttaccatgagaggattatcaagtagaaaaagaagatcacatgatgtactaaccgtgcaatttttgatcttagggatgctcttaatgacaggaggtgttacattagtaagaaagaatcgatggctgcttttaaatgtgacatcagaggatttagggaaaacattttcggtaggaacaggaaattgtactacaaatatacttgaagcaaaatattggtgcccagactctatggaatataattgtccaaatttaagtcctagagaagaacctgacgatatagattgttggtgttatggtgtagaaaatgtaagagtagcatacggcaaatgcgatagtgcaggacgttctagacgttcaaggagagccatagatctgcccactcacgaaaatcacggattgaaaacacgacaagaaaaatggatgactgggcgaatgggagaaagacaactacagaaaattgaaagatggttcgttagaaatccattctttgccgtaacagctttaacaatagcctatttagtaggtagtaatatgacacaaagagtagtaatagcattgctagtgttagcagttggaccagcttatagtgcacattgcataggaataacagatagagactttatagaaggagtacacgggggaacttgggtaagtgccactttagaacaagataaatgtgttacagtgatggcgccagataaaccaagtctggacataagtttggaaacagtagcgattgatagacccgcagaagtaagaaaagtttgttataatgctgttctaacccatgttaaaataaatgataaatgccctagcaccggagaagcccatctagcagaagaaaatgaaggagataacgcatgtaaacgaacatactcagatagaggatggggcaacggatgtggcttgtttggaaaaggtagcatagtagcatgcgctaaatttacatgcgcaaagtcaatgtcattatttgaagtagatcaaacaaaaatacaatatgtaataagagctcaattacacgtgggtgcaaaacaagaaaattggaatacagacataaagacactaaagttcgacgcattaagtggatcacaagaggtagaatttatagggtacggaaaagcgactttagagtgtcaagtccaaacagcagtagatttcggtaactcatacatagcagaaatggaaactgaaagttggatagtagatagacaatgggcacaagacttgacactaccttggcaatcaggaagcggaggagtatggagagaaatgcatcatttagtagaatttgaaccacctcatgcagcaacaataagagtattagccctaggaaaccaagaaggaagtttaaaaacagcactaacaggagctatgagagtaacaaaagatacaaatgacaacaatctatacaaattacacggaggacatgtaagctgccgggtaaagttgagcgcactaacattaaaaggaacgagttataaaatatgcacagataaaatgttctttgttaaaaatcctacagataccggtcatggaacagtagtaatgcaagtaaaagtaagtaaaggcgctccctgtagaatacctgtaatagtcgcagacgatttaaccgcagcaataaataaaggaatattagtcacggtaaacccaatagcgtcaacaaatgatgatgaagtattaatagaagttaacccaccttttggagacagttatataatagtcggaaggggtgatagtagactaacataccaatggcataaagaaggaagctcaataggaaaattatttactcaaaccatgaaaggtgtagaaaggctagctgttatgggtgacacagcatgggatttttcaagcgcaggagggttctttacatcagtaggtaaaggaatacatacagtatttggaagtgcatttcaaggattatttggtggtttaaattggataacaaaagtaataatgggcgcagttttaatatgggtaggtataaacacaagaaatatgacaatgtctatgagtatgatattggtcggagtaataatgatgtttttatcactaggagtgggtgcagatcaaggttgcgctattaattttggaaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 519 - RNA, 1966 nt, synthetic construct
  misc_feature 1..1966: note = mRNA product Design2 comprising derived and/or modified sequence from YFV 17D__NC_002031.1__X-SS-E (CDS opt6)
  source 1..1966: mol_type = other RNA
ggggcgctgcctacggaggtggcagccatctccttctcggcatcaagcttaccatgagaggattaagtagccgaaaacgaagatcacatgatgtattaacagtacaatttctaattctaggaatgctgttaatgacaggaggagtgacattagttgcacattgtataggaataacagaccgagattttatagaaggtgtacatggaggcacatgggtatcagcaacattagaacaagacaaatgtgtaactgtaatggcacctgataaaccaagtctagatataagtctagaaacagtagctatagatcgaccagcagaagttagaaaagtatgttacaatgctgtactaacacacgttaaaataaatgataaatgtccaagtaccggagaagcacatttagcagaagaaaatgaaggagataacgcatgtaaaagaacttacagtgatagaggatggggaaatggatgcggtctattcggaaaaggaagtattgtagcatgtgcaaaatttacatgtgcaaaaagtatgtcattatttgaagttgaccaaactaaaatacaatacgtaattagagcacaactacacgtgggagctaaacaagaaaactggaataccgatattaaaacattaaaatttgatgcattaagcggatcacaagaagtagaatttatcggctacggaaaagcaacattggaatgccaagtacaaactgcagtagatttcgggaatagttatatagcagaaatggaaactgaaagttggattgtagataggcaatgggcacaagatttaacactgccatggcaaagcggatcaggaggggtatggagagaaatgcaccacttagttgaatttgaaccaccacatgctgcaacgattagagttctggctttaggaaatcaagaaggatcactaaaaacagccttaacaggtgcaatgagagtaaccaaagatacaaatgacaataatttatacaaattacatggaggacatgttagctgtagagtaaaactatcagcattaactttaaaagggacaagttacaaaatttgtactgataaaatgtttttcgtgaaaaatcccacagatactggtcatggcacagtagtaatgcaagtaaaagtaagtaaaggagcgccttgtaggattccagtaatagtagcagacgatttaacagcagcaataaataaaggcatcttagtaacagtaaatcccatagcatctacaaatgacgacgaagtattgatagaagtaaatccaccattcggagattcatatataattgtaggaagaggtgacagtagattgacatatcaatggcacaaagaaggaagcagtataggaaaattatttacacaaacaatgaaaggagtagaaagattagctgtcatgggagatacagcttgggatttctcaagtgcaggaggtttctttacatcagtaggaaaaggaatacatacagttttcggttcagcattccaaggattattcggaggattaaattggataacaaaagtaataatgggagcagtattaatatgggtcggaataaacacaagaaatatgacaatgtcaatgtcgatgatattagtaggtgtaataatgatgtttctaagtttgggagtaggtgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 520 - RNA, 1996 nt, synthetic construct
  misc_feature 1..1996: note = mRNA product Design2 comprising derived and/or modified sequence from YFV 17D__NC_002031.1__X-SS-E-XX (CDS opt6)
  source 1..1996: mol_type = other RNA
ggggcgctgcctacggaggtggcagccatctccttctcggcatcaagcttaccatgagagggctatcaagtagaaaaagaagatcacatgatgtattaacagtacaattcctaatactaggcatgttattaatgacaggaggagtgacgctagttgcccactgtataggaattacagaccgtgattttatagagggagtacatggaggaacatgggtaagtgcaacattagagcaagataaatgtgttacagtaatggcacctgataaacccagcttagatataagtctcgaaacagtagcaatagatagaccagcagaagtaagaaaagtttgttataacgcagtattaactcacgtaaaaataaacgataaatgtccaagcactggagaagcacatctagcagaagaaaatgaaggtgataacgcatgtaaaaggacgtatagtgatagaggatggggaaatggatgcggactattcgggaaaggaagtattgtagcatgcgctaaatttacatgtgcaaaatccatgagtttatttgaagtagatcaaacaaaaatacaatatgtaataagagcccagctacatgtcggagcaaaacaagaaaattggaatactgatataaaaacattaaaatttgatgcgctatcaggatcacaagaagtagaatttataggatatggaaaagcaactctagaatgtcaagtacaaacagcagtagactttggaaatagttacatagcagaaatggaaacagaaagttggatcgtagatagacaatgggctcaagacttaacactaccatggcaaagtggcagtggaggagtctggagagaaatgcatcacttagtagaatttgaacctcctcacgcagcaacaataagagtattagctttaggaaatcaggaaggcagtttgaaaacagcattaacgggtgctatgagagtgactaaagacactaatgataataatctttataaactacatggagggcacgtaagctgtagagttaaattaagtgcgttaacattaaaaggtacaagctacaaaatatgcacagacaaaatgttctttgtgaaaaatccaacagacacaggacatggcacagtagtaatgcaagtaaaagtatcaaaaggagcaccatgtaggataccagtaatagtcgcagatgatttaacagcagcaataaataaaggtatattagtaacagttaatcctattgcatcaactaatgatgatgaagtactaatagaagtaaacccaccgtttggagacagttacataatagtcggaagaggagacagcaggctaacatatcaatggcataaagaaggtagctcaattggaaagctattcacgcaaacaatgaaaggagtcgaaagattagcagttatgggagacacagcatgggattttagtagtgcgggagggttctttacatcagttggtaaaggtattcatacagtatttggaagtgcatttcaaggactatttggaggattaaattggataacaaaagtcatcatgggagcagtattaatatgggtaggaataaatacaagaaatatgacaatgagcatgagtatgatattagtaggagtaataatgatgtttctaagcctaggagtaggtgcagaccaaggatgtgcaatcaacttcggaaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 521 - RNA, 2413 nt, synthetic construct
  misc_feature 1..2413: note = mRNA product Design2 comprising derived and/or modified sequence from YFV 17D__NC_002031.1__SS-prME (CDS opt6)
  source 1..2413: mol_type = other RNA
ggggcgctgcctacggaggtggcagccatctccttctcggcatcaagcttaccatggatgttctaacagtacaatttttaatattagggatgttattaatgacaggaggcgtaacattagtacgaaagaatcgatggctattactaaacgttacgtctgaagatttaggaaaaacatttagcgtaggaacaggaaattgcaccacgaatatcttagaagcaaaatattggtgtccagatagtatggaatacaattgtccaaatttaagtcctagagaggaacccgacgatatagattgctggtgttacggagtggaaaatgtaagagtagcatatggaaaatgtgacagcgcaggtagaagtagaagatcacgacgagcaattgatctacccactcatgagaaccatggactaaaaacaagacaagaaaaatggatgacaggtagaatgggcgaaagacaattacagaaaatagaaagatggtttgtacgaaatcctttctttgctgtcactgcattaactatagcttatttagtaggaagtaacatgactcaaagagtagtaatagcactattagtactagcagtaggaccagcttacagtgcacactgtatagggataacggatagagattttatagaaggagtacatgggggtacatgggtgtctgccactttagaacaagacaaatgtgttacagttatggccccagataaaccctctttagacatatcattagaaactgtagcaatagatagaccggcggaagtgagaaaggtatgttataatgcagtactaacccatgtaaaaattaatgacaaatgcccatcaacaggagaggctcatctagctgaagaaaatgaaggagacaatgcttgcaaacgtacatattcagacagggggtggggaaatggatgtggattatttggtaaagggtcaatagtagcatgtgcaaaatttacatgcgcaaaaagtatgagcttatttgaagtagatcaaacaaaaatccaatatgtaattagagctcaacttcacgtaggagcaaaacaagagaattggaacacagatataaaaacattaaaatttgacgctttgtctggaagtcaagaagtcgaatttattggctatggaaaggcaacattagaatgccaagttcaaaccgcagtagattttggaaattcatacatagcagaaatggagactgaaagttggatagtagatagacagtgggctcaagacctaactttaccatggcaatcaggaagtggtggtgtatggagagaaatgcatcatttagtagaatttgaaccaccacatgcagcaacaattagagtactagcattaggaaatcaagaaggtagtttaaagacagcgcttaccggagcaatgagagttacaaaagatactaatgacaataatttatataaacttcatggaggacatgttagctgtagagtcaaattaagtgcattaacactcaaaggaacatcatacaaaatatgtacagataaaatgtttttcgtcaagaatccaacagatacaggacatggaacagttgtaatgcaagtaaaagtatcaaaaggagcaccttgcagaataccagtaatagtagcagatgatttaacagccgcaattaataaagggatattagtaacagtaaaccctatagcaagtacaaatgatgatgaagtcttgatagaagtaaatccaccatttggagattcgtatataatagtcggaagaggagatagtcgattaacatatcaatggcataaagaaggttcatcaataggaaaattatttacacaaaccatgaaaggagttgaaagattagctgtaatgggggacacagcttgggatttttctagcgcaggaggattctttacatccgtaggaaaaggtatacacacagtatttggctcagcattccaagggttatttggtggtttaaattggataacaaaagtgattatgggagcagtgctaatctgggtaggaataaatacaagaaatatgacaatgagtatgagcatgattctcgtaggagtaataatgatgttccttagtttgggagttggcgcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 522 - RNA, 3469 nt, synthetic construct
  misc_feature 1..3469: note = mRNA product Design2 comprising derived and/or modified sequence from YFV 17D__NC_002031.1__SS-prME-NS1 (CDS opt6)
  source 1..3469: mol_type = other RNA
ggggcgctgcctacggaggtggcagccatctccttctcggcatcaagcttaccatggatgtattaaccgtacaattcttaatattaggaatgctgctaatgacaggtggagtaaccttggtaagaaagaatagatggttattactaaacgtaacttcagaagacttaggaaaaacatttagtgtaggaactggaaattgcaccacaaacattttagaagcaaaatattggtgtcccgatagtatggaatataactgtccaaacttatcaccacgagaagaacctgatgacatagattgctggtgttatggagtagaaaatgtaagagtggcatatggaaaatgtgatagtgcaggcagatctaggagatcgagacgagcaattgacctacctacacatgaaaaccatggtctaaaaacaagacaagaaaaatggatgacaggaagaatgggtgaaagacaactacagaaaattgaaagatggttcgtaagaaatccattcttcgcagtaacggcattaacaatagcatatttagtagggagtaatatgacacaaagagtagtgatagcgttgctagtattagcagtaggtcctgcatattctgctcactgtataggaattacggatagagacttcatcgaaggagtacatggaggaacatgggttagcgctacgctagaacaagataaatgtgtaactgtgatggcacctgataaaccatcgttagatatcagcttagaaactgtagcaatagacagaccagcagaagtacgaaaagtatgttacaatgctgtattaacacatgtaaaaataaatgacaaatgtccgtccactggagaagcacatttagcagaagaaaatgagggcgataatgcatgtaaacgcacttattcagaccgaggatggggaaatggttgcggattatttggaaaaggctcaatagtagcatgtgcaaaatttacgtgtgcaaaatcaatgtcactatttgaagtcgatcagaccaaaatacaatacgtaataagggcacaattacacgtcggagcaaaacaggaaaattggaatactgatataaaaacattaaaattcgatgcactctcaggatcacaagaagtagaatttataggatatgggaaagcaacgttagaatgccaggttcaaactgccgtcgattttggtaattcatatatagcagagatggaaacagaaagctggatcgtggatcgtcaatgggcacaagatttaacattaccctggcaatcaggatcaggaggtgtttggcgagaaatgcaccatttggtagaatttgaacctccacacgcggcaacaataagagtcctagcacttggtaatcaggaagggagcttaaaaaccgctttaacaggagcaatgagagtgacaaaagacacaaatgataacaatttatataaactccatggaggacatgtatcatgccgcgtaaaactatcggcattaacattgaaaggcacgtcatataaaatctgtacagataaaatgtttttcgtaaagaatccgaccgacacaggtcatgggactgttgtaatgcaagtaaaagtctcaaaaggagctccttgcagaatacctgtaattgtagccgatgatctaacagcagccattaataaaggcatactcgtaacggttaaccctatagctagtactaatgatgatgaagtattaatagaagtaaatcccccttttggagactcatatataatcgttggaagaggagactcaagattaacgtaccaatggcataaggaaggatcaagtataggtaaattattcacacaaacaatgaaaggagtcgaacgactcgcggttatgggagacacagcttgggatttttcatcagccgggggattctttacaagcgtaggtaaaggaatccatacagtgttcggttctgcattccaaggtttgttcggaggattgaattggataaccaaagtaataatgggcgcagtactaatatgggttggcataaacacccgaaacatgacaatgagcatgagtatgatacttgttggtgttataatgatgttcctctcactaggggttggggctgatcaaggatgtgccatcaattttggaaaacgcgaattaaaatgcggagatggtatatttatatttagagatagtgacgattggttaaataaatatagttattatccagaggatcccgtgaaactcgcctctattgtaaaggcttcattcgaagaggggaaatgcggcttaaattccgtagacagcttggaacatgaaatgtggagatctagagcagatgaaataaacgcaattttcgaagaaaatgaggttgatataagcgtagtcgtacaggaccccaaaaacgtttatcaaagaggtacacatccgttctcaagaatcagagatggactacagtatggatggaaaacatgggggaaaaatctggtttttagtccgggacgaaagaacggatccttcataatagatggaaaaagtagaaaagaatgtccatttagcaacagagtctggaatagttttcaaattgaagaatttggaactggcgtatttactacaagagtatatatggatgcagtatttgaatacacaattgactgtgatggatccattctaggagctgcagtaaatggaaagaaaagcgcacatggatcaccaacattttggatgggatcacacgaagtaaatggaacatggatgatacatacactagaagcacttgattataaagagtgtgaatggccgctaacacatactataggtacaagtgtagaggaatcagaaatgttcatgccaaggtcgattggaggtccagtaagctcacacaatcatatacctggatataaagtacaaacaaacggaccttggatgcaagtgcctttagaagtgaaaagagaagcatgtcctggcacatcagtgataatcgacggaaattgtgatgggaggggaaaaagcacacgtagcacaacagactctgggaaagtcattcctgaatggtgttgccgatcatgtactatgccgccagtcagcttccatggaagcgatggatgctggtatccaatggaaattagaccaagaaaaacacatgaatctcatctagtcagatcgtgggtaacagcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 523 - RNA, 10618 nt, synthetic construct
  misc_feature 1..10618: note = mRNA product Design2 comprising derived and/or modified sequence from YFV 17D__NC_002031.1__polyprotein (CDS opt11)
  source 1..10618: mol_type = other RNA
ggggcgctgcctacggaggtggcagccatctccttctcggcatcaagcttaccatgagcggtaggaaggcccagggaaaaaccctgggcgtgaacatggtccggagaggggtgagatccctgagcaacaagatcaagcaaaagacgaaacagatcggcaaccgcccggggcccagccgtggtgtgcagggcttcatcttcttcttcctgttcaacatcttgacggggaagaagatcacagcacacctcaagcgcctatggaagatgctggacccccggcagggccttgcggtgctgcgcaaggtgaagcgggttgtagcctcactgatgcgcgggttgtccagccggaaacgcaggtcccacgacgttctgacagtacagttcctcatcctcggcatgctactgatgaccgggggcgtaacgttagtgcgcaagaataggtggctgttattaaacgtgaccagcgaggacctaggcaagactttttccgtcgggaccggcaactgcacgaccaacatcctggaggccaaatactggtgtccggactcaatggagtacaactgccctaatctctctccacgcgaggagcccgacgacatcgattgttggtgctatggtgttgagaacgttcgagtagcttacggcaagtgcgactcagccggccgctcacgacgcagccggcgggcgatcgacttgcctacccatgagaatcacgggctgaagacgcgccaggagaaatggatgacgggtcggatgggcgagcgccagctccagaagatcgagcggtggttcgtgcgcaaccccttcttcgctgttaccgccctgaccatcgcttaccttgtcggtagtaacatgacccagcgggtggtgatcgcgctactggtccttgccgtgggtcccgcgtacagcgcccactgtatcggaatcacggaccgcgattttatcgagggggtgcatggaggcacctgggtctccgcaaccctcgagcaggacaagtgcgtgactgtcatggcgcccgataagcccagcctagatatctccctagagaccgtggcaatagaccggccggctgaggtacggaaagtctgctataacgctgtcttgacccatgtgaaaatcaacgacaagtgccctagcacgggcgaagcccacctggccgaggagaacgagggagacaacgcctgcaagcggacctacagcgaccgaggatggggcaacggatgtgggctgttcggtaagggctcgatcgtcgcctgcgcgaagttcacgtgcgctaaaagcatgtcactcttcgaagtggaccagaccaaaatacaatatgtgatacgggcccagctgcacgtcggcgccaagcaagaaaattggaacactgacatcaagaccctgaaatttgacgcgctcagcggaagtcaggaagtggaatttatcggctacggtaaggccacgctagagtgccaggtacaaacagccgttgactttgggaacagttatatcgcggagatggagacagagtcctggatcgtggatcgacaatgggcccaggacctaacgctcccttggcagtcgggcagtggaggcgtgtggcgagagatgcaccacctggtcgagtttgagccgccccacgccgcgacgatccgcgtactggcgctcggaaatcaagaggggagcctgaaaaccgcgctgacgggcgccatgagagtgaccaaggacacgaacgacaataacctctacaagttgcacggtggccacgtcagctgccgcgtgaagctgtctgccctgaccctcaagggcacctcctacaaaatctgcaccgacaaaatgttcttcgtaaaaaacccgaccgacacaggccatggcaccgtcgtgatgcaggttaaggtcagtaagggggccccctgccggatccccgttatcgtggcggacgacctgaccgccgccatcaacaagggcatcctggtcacagtgaacccaatcgcctcgaccaacgatgatgaggtgctgatcgaggtcaatccgccattcggggatagctatatcatcgtggggagaggggattcgaggcttacttaccagtggcacaaggaggggagctccattggtaagttgtttacacagacaatgaagggggtggaacgactcgcagtcatgggcgataccgcgtgggacttttcgagtgctggaggctttttcacctctgtcgggaagggcatccacacagtgtttggcagcgccttccaggggttattcggggggctgaactggatcacgaaggttattatgggagccgtgctcatctgggtggggatcaacacgcggaacatgacgatgtccatgtccatgatcttagtaggcgtcataatgatgtttctatcactcggcgtgggggcagaccaaggctgcgccattaattttggcaagcgtgagctgaaatgcggcgacggcatcttcatatttcgcgatagcgacgattggctaaacaagtactcctactatcccgaggaccccgtcaagctcgcgagcatcgtgaaagcctcttttgaggaagggaaatgcggcctgaacagcgtagactcccttgaacacgagatgtggcggagccgcgccgatgagattaacgccatcttcgaggagaacgaagtggatatatccgtcgtagtccaggacccgaagaacgtgtaccagagggggactcacccattcagtaggatacgggacggcctccagtacgggtggaagacttgggggaagaacctggtattttcgcccggacgaaagaacgggagcttcataatcgacgggaaatcccggaaggagtgccccttcagcaatagggtctggaacagctttcagattgaggagttcggcacgggcgttttcaccacccgggtctatatggacgccgtgttcgaatacacgatcgattgcgatgggtcgatcctgggggccgccgtgaatggcaagaagagtgcccacggtagcccgacgttctggatgggcagccacgaggtcaatgggacttggatgatccacaccttagaggcactggactacaaggagtgcgaatggcccctaacccacacgatagggacatccgtggaggagagcgagatgttcatgccccgctccatagggggccctgttagctcccacaaccacatcccaggctacaaagtccagaccaacgggccatggatgcaggtccccctcgaggtgaagcgggaggcatgtccgggcaccagtgtgatcatagatgggaattgtgacggccgcggtaagtccacgcggagcactaccgactctgggaaggtaataccggagtggtgctgccgcagttgtacgatgccacctgtctccttccacggcagcgacggttgttggtacccgatggagatccggccccgcaagacgcacgagtcgcacctcgtccggagctgggtgacagccggcgagattcatgctgtgcccttcgggttagtctccatgatgattgcgatggaggtagtcctccgcaagcggcagggccccaagcagatgctggtagggggggtggtgctattgggcgcgatgctggtcggccaagtgaccctgctcgacctgctgaagctcacagtggccgtcggtctgcacttccacgagatgaataacgggggcgacgccatgtacatggccctgatcgccgcattcagcatccggccgggtctcctgatcggatttggcctccgcacgttgtggagccctcgtgaacgcctggtactgaccctaggtgccgcaatggtggagatcgcgctgggcggggtcatgggcgggctgtggaagtacctcaatgctgtctccctgtgcattttgacgatcaacgctgtggcctcacggaaagcctccaacaccatcctccccctgatggccctgctcacccccgtcacgatggcggaagtgagacttgcggcaatgttcttttgcgccgtcgtaatcataggggttctgcaccagaacttcaaggacaccagcatgcagaagaccataccgcttgtagccctgaccctgacttcctatctcggcctcacccaaccctttctgggtctctgcgcattcctggccacccggatcttcggaaggcgctcaatccccgtaaatgaggccctcgccgccgcgggcctagtgggagtgctggcaggcttagcatttcaggagatggaaaacttcctcgggcccattgccgtgggcgggctattgatgatgctcgtgtccgtggcgggccgcgtcgacggactggagctgaagaagctcggagaggtgagctgggaggaggaggcggagatctcaggttcgtccgcccggtatgacgttgctctcagcgagcaaggggagttcaaacttctatccgaggaaaaggtcccgtgggaccaggtggtgatgaccagcctggctctggtcggcgcggccttacacccgttcgcgcttctgctcgtcctggccgggtggttattccacgtgaggggcgcccggagaagtggcgacgtcctttgggacatcccgacgccaaaaatcatcgaggagtgtgaacacctggaagacgggatctacggcatattccagagcaccttcttgggggcgtcacagcgtggcgtcggggtcgcccagggcggcgtgtttcacaccatgtggcacgtcacacgaggagcctttctcgtccggaacggaaagaagctgatcccgagctgggcctccgtgaaggaggatctggtagcctacggcggctcatggaaacttgaagggcgctgggacggtgaagaagaagtacaactgatcgcggccgtgcccggcaagaacgtggttaacgtccagacgaaacccagtctgttcaaagttcggaacggcggtgagataggagccgtcgcactggactatccgagcggcacaagcggatcccccatcgttaaccgaaacggcgaggtgatcggcctgtacgggaacggaatcctggtcggggacaacagctttgtgtccgctatcagccaaaccgaggtgaaagaggagggcaaggaggagctccaggagatccctacaatgctgaagaaaggcatgacgaccgtcctggatttccaccccggcgccggcaagacccggcgtttcctaccccagattctcgctgaatgcgcaagacggcgcctgcgaacactggttctggcccccacgcgcgtcgtccttagtgagatgaaggaggcgttccacggtctggatgtgaaattccacacccaagccttcagcgcccacggctctgggcgggaagtgatagacgcaatgtgtcacgccaccctcacgtaccgaatgctggagcccactcgtgttgtgaactgggaggtgattatcatggatgaagctcacttcctggaccccgcgtccattgccgcacgcggctgggcggcgcatcgggccagggcgaacgagtcggcgaccattctcatgaccgcgacgccgcccggcacgagcgacgagttcccccattccaatggggagattgaagacgtccagactgacattcccagtgagccgtggaacaccggccacgactggatcctggcggacaaacggcccacggcgtggttcctgccctcaatacgagccgccaacgtcatggcggcgagtctccggaaggccgggaaaagcgtggtcgtgctgaaccgcaagacgttcgagcgggagtacccaaccatcaagcaaaagaaacctgatttcatcctggcaaccgatatcgccgaaatgggcgcgaacctgtgcgtggaacgcgttcttgactgtcgtaccgcgttcaagccagttctggtcgacgaggggcgcaaggtcgccattaaaggccccctccggatttccgcctcttctgcggcgcagagacgagggcgcatcgggcgcaaccccaacagagacggggacagctactactatagcgagcctacgtccgagaacaatgcccatcacgtatgctggctagaggccagcatgctgttggataacatggaggtccgcgggggcatggtcgcacccctatacggggtggaaggcaccaaaacccccgtgtctcccggcgagatgcggctgagagacgatcaaaggaaggtcttcagagagctcgtgagaaactgtgacctgccggtctggctgtcatggcaggtcgccaaggcggggctcaagacaaacgatcgcaagtggtgcttcgagggccccgaggagcacgagatcctgaacgattctggagagactgtgaaatgcagagcccccgggggcgccaaaaagccacttcgcccgcggtggtgcgacgagcgagtctccagcgaccagtcagccctcagcgagttcatcaagtttgctgagggccggcgcggcgcggcggaggtactggtggtgctgtccgaactccccgatttcctcgccaaaaagggcggggaagcaatggacactattagcgtcttcttacactcggaggagggtagccgggcgtaccgtaacgcgctatctatgatgcccgaggcaatgaccatagtgatgttattcatcctcgctggcctgctgaccagcgggatggtaatattcttcatgtccccgaaggggatcagccgtatgtccatggcaatgggcaccatggcgggctgcggctatctgatgtttctcggaggcgtgaaacccacgcatatctcttacgttatgctgatcttctttgtcctgatggttgtggtcatccctgagcccgggcaacaacgaagcatccaggataaccaagtggcctacctcattatcgggatcctgaccctggtctccgccgttgccgccaacgagctcggtatgctggagaaaaccaaggaggaccttttcggaaagaagaacctcatcccgagctcggcgtcaccctggtcctggcctgacctggatctgaagcccggggccgcatggaccgtgtatgtagggatcgtcacgatgttgagtccaatgctgcaccactggatcaaggtggagtatggcaacctctccctctctggcattgcccagtccgccagtgtgctctccttcatggataaagggatccccttcatgaagatgaacatctcagtcatcatgctgctcgtgtctggctggaacagcatcaccgtgatgcccttgctctgcgggatcggatgtgcaatgctccattggtccctgattttgcccgggattaaggcccagcagagcaagctcgcccagcggcgggtatttcatggtgtcgccgaaaaccccgtagtcgacggtaacccaaccgtggacattgaggaggcgcccgaaatgcccgctctttacgagaagaaacttgcactctacctgttgctcgccctgtccctggccagcgtggcgatgtgtagaaccccgttctccctggcggagggcattgtcctggcctctgccgccctgggcccgctaatcgaggggaacacatcccttctctggaacggccctatggcggtcagcatgacgggcgttatgcgtgggaaccactacgccttcgtcggggtgatgtacaatctctggaaaatgaagaccggccgccgtggaagcgcaaacgggaagacgctgggagaggtatggaagcgcgagctcaacctcctggataagcggcaatttgagctgtacaagagaacggacatcgtcgaggtggacagagacactgcccggcggcacctggctgagggcaaggtggacaccggagtcgcggtgtcccgtggcacggccaagttacggtggttccacgaacgcgggtacgtgaagctggagggtcgggtcatcgacctcgggtgcggcagaggcgggtggtgttactacgccgccgcgcagaaggaggtaagcggtgtgaaagggttcacgctgggccgggacggacacgagaagcccatgaacgtacagtcactgggatggaacatcatcaccttcaaggacaagacagacatccaccgcctcgagccggttaaatgtgacaccctgctttgcgacattggtgagtcgtccagctcgagcgtgacggagggggagcggaccgtacgcgtgctcgacaccgtggaaaagtggctcgcatgcggcgtcgacaacttttgcgtgaaggtactggccccatatatgcccgacgtcctcgaaaagctcgagctgctgcagcgacgtttcggtggcaccgttatccggaacccactctcgcgcaacagtacgcacgagatgtactacgtgtcgggagcccgcagcaacgtcaccttcaccgtgaaccaaacctcccggttgctgatgcgtagaatgcgccggcccacgggcaaggtcaccctggaggccgacgtcattctgcctatcggcacccggtcggtagagaccgacaaggggccgttagataaggaggcgatcgaagagagggtggagcgcatcaaatccgagtacatgacgagctggttctacgacaacgacaacccttatagaacctggcattattgcggcagctacgtgaccaaaacctccgggagcgccgcttccatggtcaacggcgtcattaaaatcctcacctacccgtgggaccgcatagaggaggtgactcggatggctatgacagacactaccccattcggccaacagcgggtgtttaaagaaaaggtcgacacgcgggccaaggatccgcccgcgggaacacgcaagatcatgaaggtggtgaaccgatggcttttccgccacctggcccgcgagaagaacccccgcctctgcaccaaggaggagttcattgccaaagtccggagccacgccgcaatcggcgcgtacctggaggagcaggagcaatggaagaccgccaacgaggccgtgcaggaccccaagttctgggagctggttgacgaagaacgcaagttacaccagcaggggcgctgccggacgtgcgtttacaatatgatgggcaaacgagaaaagaagttgtccgagtttgggaaagctaaaggcagccgagccatctggtacatgtggcttggcgcgcgctacctcgagttcgaggcccttgggttcctgaacgaggaccactgggcctcgcgggagaactctggcggaggcgtggaagggatcggcctacaatacctcggctacgtgatcagagacttggccgcgatggacgggggcgggttctacgccgacgacactgctggctgggacacccgcatcacagaggccgacctcgacgacgagcaggagatcctgaactacatgagcccccaccacaagaagctggcccaggcggtcatggaaatgacgtataagaacaaggtagtgaaggtcctccgccccgcccccgggggcaaagcctacatggacgtgatctcgaggcgcgaccaaaggggctccggtcaggtggtcacctacgccttgaacactatcaccaacctaaaggtgcagttaatacgcatggctgaggcggagatggtgatccaccaccagcacgtccaggactgcgacgagagcgtgctgacgcgtctggaagcctggctaacagagcacgggtgtgatcgcctgaagcgtatggcagtttcaggggacgactgtgtggtgcgccccatcgacgatcggttcggactggcgctctcccacctgaacgccatgtcaaaagtgcgcaaggacatcagcgagtggcagccctccaagggttggaacgactgggagaatgtcccgttctgtagccaccactttcacgaactccagcttaaggacggccggcgcatcgtggtgccctgccgggagcaagatgagctgataggcagggggcgtgtttcccccggtaacgggtggatgatcaaggagaccgcgtgcttgagcaaggcctatgcgaacatgtggagtctcatgtactttcacaagcgggacatgcgcctactgtccctcgccgtttcttccgcggtacccacgagctgggtcccacagggccggacaacttggtccatccacgggaagggggagtggatgaccactgaggacatgctggaggtgtggaaccgagtgtggatcacgaacaacccccatatgcaggacaagacgatggtcaagaagtggcgggacgtgccgtacctaacaaagagacaggacaaactgtgtggaagccttatcggcatgaccaaccgggccacctgggcatctcacattcacttagtaatccaccgaatacggaccctaatcggccaggagaagtataccgactatttgaccgtaatggatcgctactctgtagacgccgacctgcagctcggtgagttgatctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 524 - RNA, 2719 nt, synthetic construct
  misc_feature 1..2719: note = mRNA product Design2 comprising derived and/or modified sequence from YFV 17D__NC_002031.1__C-prME (CDS opt11)
  source 1..2719: mol_type = other RNA
ggggcgctgcctacggaggtggcagccatctccttctcggcatcaagcttaccatgtcgggcaggaaagcacaaggcaaaacgctaggagtaaatatggtcagacggggcgtacgcagcctatcaaacaagataaagcagaaaaccaaacaaatcggaaaccgacccggaccaagccggggcgtccaaggattcatcttcttctttctattcaacatactaaccggaaagaaaatcacagcgcacttaaaacgcctatggaaaatgctagacccccgccaaggactcgccgtgctaaggaaagtgaaacgagtcgtagcctccctgatgcgcggactgagcagcaggaaaagacgaagccacgacgtcctgacagtacaattccttattctcggaatgctactcatgacgggcggagtcaccctagtgaggaaaaaccgctggctcctgctcaacgtaacaagcgaagatctgggaaaaacattcagcgtcgggacaggaaactgcaccaccaacatcctagaagcaaaatactggtgccccgacagcatggaatacaactgccccaatctaagcccaagagaggaacccgacgacatagactgttggtgttacggggtcgaaaatgtcagagtcgcgtacggcaagtgcgactcggcaggcagaagccgaaggagtcgacgcgcaatcgacttgccgacccatgaaaaccacggcttaaaaacccgacaagaaaagtggatgacgggacgcatgggagagcgccaactccagaaaatagaacgatggttcgtgagaaacccgttcttcgcggtaaccgcactaacgatagcatacctcgtcgggtccaacatgacgcaaagggtagtgattgcactcctagtgctagccgtgggcccagcatactccgcacactgcataggcatcacagacagagacttcatcgagggagtgcacggaggcacatgggtaagcgcaaccctcgagcaagacaaatgcgtaacagtcatggcacccgacaaacccagcctagacataagcctcgaaacagtcgccatcgaccgcccagcagaagtacgcaaagtctgctacaacgcagtacttacgcacgtaaaaatcaacgacaaatgccctagcacaggcgaagcacacctcgcagaagaaaacgagggagacaacgcgtgcaagagaacgtactcagaccgaggctggggaaacggatgcggactattcgggaaaggaagcatcgtcgcatgcgcaaaattcacgtgcgcgaaaagcatgagcctctttgaagtagaccagaccaagattcaatacgtcataagagcgcaactgcacgtaggagcgaaacaggagaactggaacaccgacataaaaacactaaagttcgacgcactctcagggagtcaagaagtcgagttcataggatacggaaaggcaacactcgaatgccaagtccaaacagcagttgacttcgggaactcatacatagcggagatggaaacagagagctggatcgtcgacagacagtgggcccaggacttaacactaccctggcagagcggctcgggaggcgtctggcgcgagatgcaccacctggtcgagttcgaaccaccgcacgcagccacaatacgagtattggccctaggaaatcaagaaggctcgctcaaaacggcactaacaggagcaatgagggtcacgaaagacacaaacgacaataacttgtacaaactccatggcgggcacgtgtcatgccgcgtaaaactgagcgcgctcaccctaaaaggaaccagctacaaaatatgcacagacaagatgttctttgtcaaaaaccccactgacacaggacacggaacggtagtaatgcaagtcaaagtaagcaagggcgcaccatgccggataccggtcatagtcgcagacgacctaacagcggcaatcaataaaggtatactggtgacagtcaacccaatagccagcaccaacgacgacgaagtcctaatagaagtaaacccacccttcggcgactcctacatcatagtagggaggggagactcgcgattgacctaccaatggcacaaagaaggaagctcaataggcaagttgttcacacaaacgatgaagggagtagagaggctagccgtcatgggagatacagcatgggacttcagcagcgcaggcgggttcttcacatcagtgggtaaggggatacatacggtattcggcagcgccttccagggattgttcggaggcctaaactggatcaccaaagtcatcatgggggcagtcctaatatgggttggaataaacacacggaacatgacaatgagcatgagcatgatactcgtcggggtgataatgatgttcctgagcctcggagtaggtgcttgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 525 - RNA, 3775 nt, synthetic construct
  misc_feature 1..3775: note = mRNA product Design2 comprising derived and/or modified sequence from YFV 17D__NC_002031.1__C-prME-NS1 (CDS opt11)
  source 1..3775: mol_type = other RNA
ggggcgctgcctacggaggtggcagccatctccttctcggcatcaagcttaccatgtcgggacgcaaagcgcaaggcaaaacgctaggagtgaacatggtccgacgcggagtaaggagcctgagcaacaaaatcaaacagaaaacaaaacaaataggcaatcgcccgggcccgagcaggggcgtgcagggattcatattcttcttcttattcaacatcctcacaggaaagaaaataacggcccatctaaaacgactctggaaaatgttagacccaagacaaggcctcgctgtactcagaaaagtaaaacgcgtcgtcgcctcccttatgcggggactatcaagccgcaaaagacgatcacacgatgtactcacggtgcagttcctcatacttggaatgttgctaatgaccggaggagtaaccttagtacgaaagaaccgatggctgttactcaacgtcacgagcgaagacctaggcaaaaccttctcagttggaacgggtaattgcacgacaaacatactcgaagccaaatattggtgcccagactccatggaatataactgccccaatctaagcccacgagaggaacccgacgacatagattgctggtgctatggagtagaaaacgtacgcgtcgcatacggaaaatgcgactcagcgggccgctcacggcggtcacggagagcaatagacctacccacacatgagaaccacgggctaaaaactcgtcaggaaaaatggatgaccggccgcatgggcgagcgacaactacagaaaatagagaggtggttcgtaagaaacccatttttcgcggtcacagcactcacaatcgcatacctagtaggaagcaatatgacgcaaagggttgtaatagccctgctagtcctggccgtagggccggcatactccgcccactgcatcggtataacggatagggacttcatagaaggcgtacacggagggacatgggtaagcgcaacactagagcaggacaaatgcgtaaccgtcatggcacccgacaaaccgagcttggatatctcactcgaaaccgtcgcgatcgacagacccgcagaggtcagaaaagtatgctacaacgccgtcctgactcacgtaaaaatcaacgacaaatgccccagcactggagaggcacacctggccgaagagaacgaaggcgacaacgcatgcaaacgcacgtacagcgacagagggtggggcaacggctgcggcctgttcggcaaggggagcatagtagcctgcgcaaaattcacatgcgccaagagcatgtcgctgttcgaggtagaccaaaccaagatccaatacgtaatcagagcacagctacacgtgggtgcaaaacaggagaactggaacaccgacatcaaaaccctcaagttcgacgcgctcagtggctcacaagaagtagagttcataggatacggaaaagcaaccctggaatgccaagtccaaacagcagtagacttcgggaactcgtacatagccgagatggagaccgaaagctggatagtagatcgacaatgggcacaggacctcaccctaccgtggcaaagtgggagcggaggggtctggcgagaaatgcaccacctagtggaatttgagccgccacacgcagccacgatacgcgtgcttgcactgggcaaccaagaagggtctctaaaaaccgcccttacgggcgctatgagagtcacaaaagacacgaacgacaataacctgtacaagctacatgggggacatgtcagctgccgcgtcaaactcagcgcactcacgctcaaaggcacgagctacaagatatgcaccgacaaaatgttcttcgtcaaaaacccgacagacactgggcacgggacggtagtgatgcaagtcaaagtatcaaagggcgcaccatgccgcattccagttatagttgccgacgacctaacagccgcaatcaacaaaggcatcctagtcacggtaaacccgatagcatccaccaacgacgacgaagtactgatagaagtcaacccgccattcggagactcatacataatagtcggacggggcgacagccgcctaacctaccaatggcacaaggaaggcagctccatcggaaaattgttcacgcaaacaatgaaaggcgtcgaacgcctagcggtcatgggcgacacagcgtgggacttttccagcgcagggggcttcttcacgtccgtagggaaaggcattcacacggtgttcggaagcgcgttccaaggactgttcggcgggttgaactggatcacgaaagtgatcatgggtgcagtacttatatgggtgggaataaacacacgcaacatgacgatgtcaatgtcaatgatcctagtcggagtcataatgatgttcctcagcctaggcgtcggagcagaccagggctgcgccataaacttcggcaagcgcgaactaaagtgcggcgacggcatattcatcttccgcgactctgatgactggctgaacaaatacagctactacccagaggacccggtcaaattggcctccatagtaaaagctagctttgaggaagggaagtgcgggctcaacagcgtagacagcctcgaacacgagatgtggcgcagtcgtgcagatgaaataaacgcgatattcgaagaaaacgaagtcgacataagcgtggtagtacaggatccgaaaaacgtttaccaacgcggaacccacccattcagcagaatacgagacgggctgcaatacgggtggaaaacgtggggcaagaacctggtattcagccccggccgcaaaaacggcagcttcataatagacggcaaaagcagaaaagaatgccccttcagcaaccgtgtatggaatagcttccaaatcgaagagttcggaaccggtgtattcaccacccgagtctacatggacgcagtcttcgaatacacaatcgactgcgacggcagcatcctgggcgcagcagtaaatgggaagaaatcagcccacggtagcccaacattctggatgggcagccacgaagtaaacggaacgtggatgatccacacactggaagccctagactacaaagaatgcgagtggccattgacacacaccatcgggactagcgtcgaagagtcagagatgttcatgccgcgaagcatagggggcccggtatcaagccacaaccatatcccgggatacaaagtgcaaacgaacggcccgtggatgcaggtacccctcgaagtaaaacgagaagcctgcccaggcaccagcgtcataatagacggcaactgcgatggccggggaaaaagcacccgaagcaccacagactcgggaaaagtcatcccggaatggtgctgcagaagctgcacgatgccacctgtatcgtttcacggaagcgacgggtgctggtacccaatggaaatccgaccaaggaaaacacatgagagccatctagtccgatcctgggtcacagcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 526 - RNA, 2476 nt, synthetic construct
  misc_feature 1..2476: note = mRNA product Design2 comprising derived and/or modified sequence from YFV 17D__NC_002031.1__X-SS-prME-XX (CDS opt11)
  source 1..2476: mol_type = other RNA
ggggcgctgcctacggaggtggcagccatctccttctcggcatcaagcttaccatgcggggactaagcagcagaaaaagacgcagccacgatgtgctcaccgtgcaattcctcatactggggatgctcctaatgaccggaggcgtgaccctagtaaggaaaaacagatggctactactaaacgtaacctcagaagatctaggaaagacattttcagtcggcacaggcaactgcacaaccaacatactagaagcaaaatattggtgcccagacagcatggaatacaactgtcccaacctcagcccaagagaggaaccagacgacatagactgctggtgttacggagtagaaaacgtaagagtggcatacggcaaatgcgacagcgcaggcaggagccgaagatcccgcagagccatcgacttgcccacgcacgaaaaccacggcctcaaaacacgacaagaaaaatggatgacagggcgaatgggagaacgacagctccagaaaatagaacgatggttcgtccggaacccgttcttcgcagtaacggcactaacaatcgcatacctcgtaggcagcaacatgacacaaagagtggtcatcgcgctactcgtactagcagtggggcccgcatacagtgcacactgcataggaatcacagaccgtgacttcatcgaaggcgtacacggaggaacgtgggtaagcgcgacactggaacaagacaaatgcgtgacagtaatggcaccagacaaaccaagcctagacatatccctagaaacggtcgccatcgaccgtcccgcagaagtacgaaaggtatgctataatgcagtcctcacacacgtcaaaataaacgacaaatgccccagcacgggcgaagcacacctcgccgaagaaaacgaaggggataacgcgtgcaaacgcacctactccgacaggggatggggcaacggatgcggactgttcggaaaaggatccatagtcgcatgcgcaaaatttacctgcgcaaaaagcatgagcttgttcgaggtagaccaaacgaagatccaatacgtaatccgagctcaactacacgttggggccaagcaagagaactggaatacggacatcaaaacactaaaattcgacgcactctccggctcacaagaagtcgagttcatcggctacggcaaagcaacactagaatgccaagtacaaacagcggtggacttcggcaacagctacatagcagaaatggaaacagaaagctggatagtagaccgacaatgggcacaagacctaactctgccatggcaaagcggctcaggaggagtgtggagagagatgcaccacctggtagagttcgaacccccacacgcagcaacaataagggtactggcactaggcaaccaagaaggcagcctaaaaaccgcactcacaggagccatgcgcgtgacgaaggacaccaacgacaacaacctctacaaactccacggagggcacgtatcctgccgcgtaaaactatcagcactaacgctaaaaggaacaagctacaaaatatgcacagacaaaatgttcttcgtcaaaaaccccacagacacaggccacggcacagtcgtaatgcaagtgaaggtcagcaagggggccccctgccgaatcccagtcatagtggcagacgacctcacggccgccatcaacaaagggatcctggtaacagtgaacccaatagcatcgaccaacgacgacgaagtcctcatagaagtgaatcccccgttcggcgacagctacatcatcgtaggacgcggcgactcccgactgacgtaccaatggcataaagaaggcagcagcattggaaaactattcacccaaaccatgaagggcgtcgaaagactcgcggtgatgggagacaccgcatgggacttctcgagcgcaggcggcttcttcacaagcgtaggaaaagggattcacacagtattcggatccgcattccaaggcctcttcgggggactaaactggataacgaaagtaataatgggagcagttctcatatgggtaggaatcaacacacgaaacatgacaatgtccatgtcaatgatactcgtaggcgtaatcatgatgtttctgtcactcggagtgggagcagaccaaggttgcgccataaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 527 - RNA, 1966 nt, synthetic construct
  misc_feature 1..1966: note = mRNA product Design2 comprising derived and/or modified sequence from YFV 17D__NC_002031.1__X-SS-E (CDS opt11)
  source 1..1966: mol_type = other RNA
ggggcgctgcctacggaggtggcagccatctccttctcggcatcaagcttaccatgagaggactatcgagcaggaaacgacgatcgcacgacgtactgacagtgcaattcctcatactaggaatgctgctaatgacagggggcgtgacactggttgcacactgcatagggataacagacagggactttatcgagggcgtacacggaggcacgtgggtcagcgcaacactagaacaggacaagtgcgtgaccgtgatggcccccgacaaacccagcctggacataagcctagaaacagtcgcgatcgaccgcccggccgaagtcaggaaagtgtgttacaacgcggtactgacccacgtcaaaataaacgacaaatgcccaagcacgggcgaagcccacctagcagaagagaacgagggcgacaacgcatgcaaacgcacctactcggacagaggatggggaaacggctgcggcctattcgggaaagggagcatagtcgcatgtgcgaaatttacctgcgccaagagcatgtccctgttcgaagtagaccaaacaaaaatacaatacgtaataagagctcaactgcacgtcggagcgaaacaggaaaactggaacaccgacatcaagaccctgaaattcgacgcgttatcaggctcacaagaggtcgagtttataggctatggcaaggccacacttgaatgccaggtccagaccgcggtagacttcgggaactcatacatagcagagatggaaactgaaagctggatcgtagaccgacaatgggcacaggacctgaccctgccgtggcagtcaggctcgggaggagtctggcgagaaatgcatcacctggtagaatttgagcccccgcacgcggcaacaatcagggtcttagccttgggcaaccaagagggctcgctcaaaacagcgctcacaggcgcgatgcgggtcacgaaagacacaaacgacaacaacctgtacaaactacacggcggccacgtgtcatgccgcgtgaaactaagcgcgctcacgctcaagggaacaagctataaaatatgcacggacaagatgtttttcgtcaaaaacccaacagacacaggccacggcacggtagtgatgcaggtcaaggtctcaaaaggggccccgtgcagaataccagtgatagtcgcggacgacctcacagccgcgatcaacaaagggatcctggtcacagtaaaccccatagcctcaacgaacgacgacgaggtactcatagaagtgaacccgcccttcggagacagctacatcatagtaggacgaggggactcgcgcctgacctaccaatggcacaaggaagggagctcgatagggaaattattcacgcaaacaatgaaaggagtagaacggctcgccgttatgggagacaccgcgtgggacttctccagcgccggcggattctttaccagcgtagggaaagggatccacaccgtattcggaagcgcattccaaggcctgttcgggggcctcaactggatcacaaaagtgatcatgggtgcagtactgatttgggtcggaatcaacaccagaaacatgaccatgtccatgagcatgatactcgtaggggtcataatgatgttcctgagcctaggcgtgggcgcgtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 528 - RNA, 1996 nt, synthetic construct
  misc_feature 1..1996: note = mRNA product Design2 comprising derived and/or modified sequence from YFV 17D__NC_002031.1__X-SS-E-XX (CDS opt11)
  source 1..1996: mol_type = other RNA
ggggcgctgcctacggaggtggcagccatctccttctcggcatcaagcttaccatgcgcggactctcgtcaagaaagagacgctcgcacgacgtcctcaccgtacaattcctaatcctgggaatgctcctcatgacaggaggcgtaacgctcgtcgcccactgcatcgggatcacagaccgggacttcatcgaaggcgtacacggaggcacatgggtaagcgccaccctagaacaagacaaatgcgtaaccgtaatggcgccagacaaaccgagcctcgacataagcctagaaacggtcgcgatagaccgtccggcagaagtcaggaaagtatgctacaacgcggtactaacccacgtcaaaatcaacgacaaatgcccgagcactggggaggcacacctcgcagaagagaacgaaggcgacaacgcgtgcaaacgcacatactcggaccgaggctggggaaacggatgcggcctgttcgggaaaggcagcatagtcgcgtgcgccaaatttacctgcgccaaaagtatgagcctattcgaggtagaccaaaccaaaatccaatacgtaataagagcacaactgcacgtaggcgcaaaacaagaaaactggaacaccgacatcaaaaccctaaaattcgacgccctatcgggatcgcaagaagtcgagttcattggctacggcaaagctacgctagaatgccaagtacaaaccgcggtagacttcgggaactcatacatagccgaaatggaaaccgagagctggatcgtcgataggcaatgggcccaagacctgaccctaccctggcaatcggggtcgggcggggtctggcgcgagatgcatcacttagtcgagttcgaaccaccgcacgcggccaccatcagggtattagccctcggaaatcaagaaggatcactcaaaaccgcgctaacaggcgccatgcgggtaacaaaagacaccaacgacaataacctatacaaacttcacggcggacacgtaagctgccgcgtaaaactcagcgcactgaccctaaagggcacgagctacaaaatatgcacggacaaaatgttcttcgtaaagaacccaacagacaccggacacggaacggtagtaatgcaagtaaaggtatccaaaggagcaccatgcagaatcccagtcatagtcgccgacgacctcacagccgcaataaacaaagggatcctagtcactgtcaaccccatagcctccaccaacgacgacgaagtactaatagaagtcaacccacccttcggcgacagctacataatagtaggacgtggggactcccgcctcacctaccaatggcacaaagaaggaagctccatagggaagctgttcacccaaacaatgaaaggagtcgaaagactagccgtaatgggcgacaccgcatgggacttctcaagcgcgggcgggttcttcacctctgtaggcaagggcatccacaccgtgttcggaagcgcattccagggcctattcggaggcctgaactggatcacgaaagtaattatgggagcagtactaatctgggtcgggataaatacaagaaacatgactatgagtatgagcatgatcctcgtcggagtaataatgatgttcctaagcctcggtgtgggcgcagaccaaggctgcgccataaacttcggcaaatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 529 - RNA, 2413 nt, synthetic construct
  misc_feature 1..2413: note = mRNA product Design2 comprising derived and/or modified sequence from YFV 17D__NC_002031.1__SS-prME (CDS opt11)
  source 1..2413: mol_type = other RNA
ggggcgctgcctacggaggtggcagccatctccttctcggcatcaagcttaccatggacgtccttacggtacaattcctaatactaggaatgcttctcatgaccgggggcgtcaccctagtccggaaaaacagatggctactgctaaatgttacaagcgaagaccttggcaagacattcagcgtaggcacgggcaactgtacaaccaacatactagaagcgaaatactggtgcccagactccatggagtacaactgccccaacctaagcccacgggaagaacccgacgacatagactgctggtgttacggggtcgaaaacgtccgcgtcgcatacgggaaatgcgatagcgcaggccgcagtagacgctcccgccgcgccatagacctaccaacgcacgagaaccacggcctcaaaactcgccaagaaaaatggatgacagggcgaatgggtgaacgccaactacagaagatcgaaaggtggttcgtcaggaacccattcttcgcagtgaccgcactaacgatagcctacctagtgggatcaaacatgacgcaacgagtcgtgatcgcactcctagtactggccgtaggaccggcctactccgcgcactgcatcggcataacggatagggacttcattgaaggagtacatggcggcacgtgggtcagcgcgacactcgaacaagacaaatgcgtaaccgtgatggcacccgacaaaccgagtcttgacataagcctggaaacggtagcgatagatcgtccagccgaagtaagaaaagtatgctacaacgcagtcctaacacacgtaaaaataaacgacaaatgcccaagcacaggggaagcccacctcgcagaagagaacgaaggcgacaacgcatgcaaacgcacatactccgacaggggatgggggaatggctgcggactattcgggaaaggaagcatcgtcgcgtgcgccaaattcacatgcgccaagagcatgagcctgttcgaagtcgaccaaacaaaaatccaatacgtaatacgcgcgcaactgcacgtaggagcgaaacaggaaaactggaacacggacattaaaaccctcaaattcgacgcgctctcaggatcacaagaagtcgagttcatcggctacggcaaggcaacgctcgaatgccaagtacaaacagcagtagacttcggaaacagctacattgccgagatggaaaccgagagctggatagtcgacagacaatgggcccaagacctaaccctgccatggcaatcaggctccgggggcgtctggcgagagatgcaccacctagtagagttcgaaccaccccacgccgccacgatcagagtactggccctgggcaaccaagaaggctcactcaagacggcgctcacaggagcaatgagggtcacgaaagacaccaacgacaacaacctctacaaactacacggagggcacgtgagctgccgggtaaaactgagcgcactcactctgaagggaacaagctacaagatatgcaccgacaaaatgttcttcgtgaaaaacccaaccgacactggacacggcacggtcgttatgcaagtcaaggtatcaaaaggagccccatgcagaatcccagtaatagtagcggacgacctaacagccgccataaacaaaggaatcctagtcacggtaaatccgatagcatcgaccaacgacgacgaagtactaatagaagtgaacccaccattcggcgacagctacataatagtcgggagaggcgactcgcgactaacctaccaatggcacaaggaagggagctctatcgggaaactattcacccaaacgatgaagggcgtagaaaggctcgcagtcatgggcgacaccgcatgggacttctccagcgcgggaggcttctttacttcagtgggaaaagggatacacaccgtcttcggcagcgcattccagggcctattcggcgggttaaactggatcacgaaagtgataatgggggcagttctcatctgggtcggaataaacacacgtaacatgaccatgagcatgagcatgatcctagtcggggtcataatgatgttcttgagcttgggagtaggtgcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 530 - RNA, 3469 nt, synthetic construct
  misc_feature 1..3469: note = mRNA product Design2 comprising derived and/or modified sequence from YFV 17D__NC_002031.1__SS-prME-NS1 (CDS opt11)
  source 1..3469: mol_type = other RNA
ggggcgctgcctacggaggtggcagccatctccttctcggcatcaagcttaccatggacgtactgaccgtacaattcctcatcctcggcatgctactcatgaccgggggcgtaactttggtccgcaaaaatcggtggctcctcctaaacgtcacatcagaagacctcgggaaaacgttcagcgtaggaacaggaaattgcacgaccaacatcctcgaagcgaaatactggtgcccagacagcatggaatacaactgtcccaacctcagcccccgggaagaacccgacgacatcgactgctggtgttacggagtcgagaacgtccgcgtggcctacggcaaatgcgactccgcaggccggagtagaagatcacgtcgcgcgatcgacctgcccacacatgaaaaccacggattaaaaacccgacaggaaaagtggatgaccgggagaatgggagaaagacaactccagaaaatagaaagatggttcgtccgaaacccgttctttgcagtaaccgccctcacaatagcatacctcgtcgggagcaacatgacccaacgggtcgtgatcgccctcctagtactagcggtcggaccagcgtacagcgcacactgcataggcataacagatcgtgacttcatagagggagtacatggtgggacatgggtgtccgcaaccttagaacaagacaaatgcgtcaccgtcatggcgcccgacaagcccagcttagacatatccctggaaacggtggccatcgacagaccggccgaagtgcgcaaagtatgctacaacgcggtactcacccacgtcaaaataaacgacaaatgcccaagcacaggagaggcacacctggccgaagagaacgaaggcgacaacgcgtgcaagcgaacatactcagacagaggatgggggaacggctgcggcctattcggaaagggaagcatagtagcgtgtgcaaaatttacctgcgccaagagcatgagtttgttcgaggtcgaccaaacaaaaatccaatacgtgatccgagcacaactgcacgtaggcgcaaaacaagaaaactggaacaccgacataaagacactgaaattcgacgcactgagtggctctcaggaggtcgagttcataggctacgggaaggcaacactcgaatgccaagtccaaaccgcggtagatttcgggaacagctacatcgcagaaatggaaacagaaagctggatcgtggaccgccaatgggcccaagacctaaccctaccctggcagtcaggcagtggcggcgtctggcgagaaatgcaccatctcgtggagttcgaaccaccccacgccgccacgatcagagtcctcgccctcggtaaccaggagggatccctaaagacagcactgaccggagcgatgcgtgtaacaaaagacaccaatgataacaacctatacaaactgcacggcgggcacgtgagttgccgcgtgaaactaagcgcgcttacactcaaaggcacaagctacaaaatatgcacggacaaaatgttcttcgtcaagaacccaaccgacacgggccatggaaccgtcgtaatgcaagtcaaggtatcgaaaggcgcaccgtgcagaataccagtgatagtggcggatgacctcaccgcagcaatcaacaaaggcatcctggtcacagtcaacccaatagcctccacgaacgacgacgaagtcctgattgaggtaaacccaccgttcggagacagctacatcatagtcggacgcggagacagtcgcttaacataccagtggcacaaagaagggagctcaataggaaagttattcacgcaaactatgaaaggagtagaacgactagcggtaatgggcgacacagcgtgggacttctcaagcgcgggtggctttttcacatcggtagggaaaggcatccatacagtattcggaagcgccttccagggtttattcggcgggctgaattggatcacaaaagtaatcatgggcgcggtcttaatctgggtgggcatcaacacccgaaacatgacaatgagcatgagcatgatcctagtcggcgtcatcatgatgttcctctccctgggcgtgggcgcagaccagggatgcgccatcaacttcggaaagcgcgagctaaagtgcggcgacggcatcttcatattcagggatagcgacgactggctaaacaaatactcctattatccagaagaccccgtcaaactagcctcaatcgtgaaagcgagcttcgaggaaggcaaatgcgggctaaactcagtagactcactcgaacatgaaatgtggagatcaagagcagacgagatcaacgcaatcttcgaagaaaacgaagtcgacatcagcgtggtcgtccaagaccccaaaaacgtgtaccaacgcggaacccaccccttcagccggatccgcgacggactacaatacgggtggaaaacatggggcaagaacctcgttttcagccccggacggaagaacggctccttcatcatcgacggaaaaagcagaaaagagtgcccattctcaaaccgagtctggaactctttccaaatcgaagagttcgggacaggcgtcttcacgacccgcgtatacatggacgccgtgttcgagtacacaatagactgcgacggatcaatattaggagcagccgtgaacggaaagaaaagcgcacacggatcacctacattctggatgggctcacacgaggtcaacggcacatggatgatacacaccctagaggccctcgactacaaagaatgcgagtggcctctaacccataccatcggaacaagcgtggaagagtccgagatgtttatgccaaggtcgatcgggggcccagtgtccagccataaccacataccagggtacaaagtgcaaacaaacggtccgtggatgcaggtaccactagaggtcaagcgggaagcatgccccgggacatcagtcataatcgacggcaactgcgatggcagaggcaaaagcacacgttccaccacggactcaggaaaagtaataccagaatggtgctgcagaagttgcacaatgcccccagtaagtttccatggatccgacggatgctggtacccaatggaaatcagacctcggaaaacgcacgagagccatctggtcagaagctgggtcaccgcatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 531 - RNA, 2719 nt, synthetic construct; identical to SEQ ID NO: 484
  misc_feature 1..2719: note = mRNA product Design2 comprising derived and/or modified sequence from YFV 17D__NC_002031.1__C-prME (CDS opt16)
  source 1..2719: mol_type = other RNA

SEQ ID NO: 532 - RNA, 3775 nt, synthetic construct; identical to SEQ ID NO: 485
  misc_feature 1..3775: note = mRNA product Design2 comprising derived and/or modified sequence from YFV 17D__NC_002031.1__C-prME-NS1 (CDS opt16)
  source 1..3775: mol_type = other RNA

SEQ ID NO: 533 - RNA, 2476 nt, synthetic construct; identical to SEQ ID NO: 486
  misc_feature 1..2476: note = mRNA product Design2 comprising derived and/or modified sequence from YFV 17D__NC_002031.1__X-SS-prME-XX (CDS opt16)
  source 1..2476: mol_type = other RNA

SEQ ID NO: 534 - RNA, 1966 nt, synthetic construct; identical to SEQ ID NO: 487
  misc_feature 1..1966: note = mRNA product Design2 comprising derived and/or modified sequence from YFV 17D__NC_002031.1__X-SS-E (CDS opt16)
  source 1..1966: mol_type = other RNA

SEQ ID NO: 535 - RNA, 1996 nt, synthetic construct; identical to SEQ ID NO: 488
  misc_feature 1..1996: note = mRNA product Design2 comprising derived and/or modified sequence from YFV 17D__NC_002031.1__X-SS-E-XX (CDS opt16)
  source 1..1996: mol_type = other RNA

SEQ ID NO: 536 - RNA, 2413 nt, synthetic construct; identical to SEQ ID NO: 489
  misc_feature 1..2413: note = mRNA product Design2 comprising derived and/or modified sequence from YFV 17D__NC_002031.1__SS-prME (CDS opt16)
  source 1..2413: mol_type = other RNA

SEQ ID NO: 537 - RNA, 3469 nt, synthetic construct; identical to SEQ ID NO: 490
  misc_feature 1..3469: note = mRNA product Design2 comprising derived and/or modified sequence from YFV 17D__NC_002031.1__SS-prME-NS1 (CDS opt16)
  source 1..3469: mol_type = other RNA

SEQ ID NO: 538 - RNA, 2476 nt, synthetic construct
  misc_feature 1..2476: note = mRNA product Design2 comprising derived and/or modified sequence from YFV 17D__NC_002031.1__X-SS-prME-XX (CDS opt17)
  source 1..2476: mol_type = other RNA
ggggcgctgcctacggaggtggcagccatctccttctcggcatcaagcttaccatgcggggcctctcctcccggaagcggcggtcccacgacgtcctcaccgtccagttcctcatcctcggcatgctcctcatgaccggcggcgtcaccctcgtccggaagaaccggtggctcctcctcaacgtcacctccgaggacctcggcaagaccttctccgtcggcaccggcaactgcaccaccaacatcctcgaggccaagtactggtgccccgactccatggagtacaactgccccaacctctccccccgggaggagcccgacgacatcgactgctggtgctacggcgtcgagaacgtccgggtcgcctacggcaagtgcgactccgccggccggtcccggcggtcccggcgggccatcgacctccccacccacgagaaccacggcctcaagacccggcaggagaagtggatgaccggccggatgggcgagcggcagctccagaagatcgagcggtggttcgtccggaaccccttcttcgccgtcaccgccctcaccatcgcctacctcgtcggctccaacatgacccagcgggtcgtcatcgccctcctcgtcctcgccgtcggccccgcctactccgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgccgaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 539 - RNA, 1966 nt, synthetic construct
  misc_feature 1..1966: note = mRNA product Design2 comprising derived and/or modified sequence from YFV 17D__NC_002031.1__X-SS-E (CDS opt17)
  source 1..1966: mol_type = other RNA
ggggcgctgcctacggaggtggcagccatctccttctcggcatcaagcttaccatgcggggcctctcctcccggaagcggcggtcccacgacgtcctcaccgtccagttcctcatcctcggcatgctcctcatgaccggcggcgtcaccctcgtcgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgcctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 540 - RNA, 1996 nt, synthetic construct
  misc_feature 1..1996: note = mRNA product Design2 comprising derived and/or modified sequence from YFV 17D__NC_002031.1__X-SS-E-XX (CDS opt17)
  source 1..1996: mol_type = other RNA
ggggcgctgcctacggaggtggcagccatctccttctcggcatcaagcttaccatgcggggcctctcctcccggaagcggcggtcccacgacgtcctcaccgtccagttcctcatcctcggcatgctcctcatgaccggcggcgtcaccctcgtcgcccactgcatcggcatcaccgaccgggacttcatcgagggcgtccacggcggcacctgggtctccgccaccctcgagcaggacaagtgcgtcaccgtcatggcccccgacaagccctccctcgacatctccctcgagaccgtcgccatcgaccggcccgccgaggtccggaaggtctgctacaacgccgtcctcacccacgtcaagatcaacgacaagtgcccctccaccggcgaggcccacctcgccgaggagaacgagggcgacaacgcctgcaagcggacctactccgaccggggctggggcaacggctgcggcctcttcggcaagggctccatcgtcgcctgcgccaagttcacctgcgccaagtccatgtccctcttcgaggtcgaccagaccaagatccagtacgtcatccgggcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccggcagtgggcccaggacctcaccctcccctggcagtccggctccggcggcgtctggcgggagatgcaccacctcgtcgagttcgagcccccgcacgccgccaccatccgggtcctcgccctcggcaaccaggagggctccctcaagaccgccctcaccggcgccatgcgggtcaccaaggacaccaacgacaacaacctctacaagctccacggcggccacgtctcctgccgggtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccggatccccgtcatcgtcgccgacgacctcaccgccgccatcaacaagggcatcctcgtcaccgtcaacccgatcgcctccaccaacgacgacgaggtcctcatcgaggtcaacccccccttcggcgactcctacatcatcgtcggccggggcgactcccggctcacctaccagtggcacaaggagggctcctccatcggcaagctcttcacccagaccatgaagggcgtcgagcggctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccggaacatgaccatgtccatgtccatgatcctcgtcggcgtcatcatgatgttcctctccctcggcgtcggcgccgaccagggctgcgccatcaacttcggcaagtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 541 - protein, 687 aa, synthetic construct
  REGION 1..687: note = derived and/or modified protein sequence (wt) from YFV__L06480__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTSIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVPKGAPCRIPVIVADDLTAAINKGILVTVNPIASTNDDEVLIEVNPPFGDSYIIVGRGDSRLTYQWHKEGSSIGKLFTQTMKGVERLAVMGDVAWDFSSAGGFFTSVGKGIHTVFGSAFQGLFGGLNWITKVIMGAVLIWVGINTRNMTMSMSMILVGVIMMFLSLGVGA

SEQ ID NO: 542 - protein, 697 aa, synthetic construct
  REGION 1..697: note = derived and/or modified protein sequence (wt) from YFV__D14458__X-SS-prME-XX
MRGLSSRKRRSYEVLTVQFLILGMLLMTGGVTLVRKSRWLLLNVTSEDLGKTFSVGTGNCTTNILEAKNWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALAIAYLVGSNMTQRVVIALLVLAVGPAYSAHCIGITDRDFIEGVHGGTWVSATLEQDKCVTVMAPDKPSLDISLETVAIDGPAEARKVCYSAVLTHVKINDKCPSTGEAHLAEENEGDHACKRTYSDRGWGNGCGLFGKGSIVACAKFTCAKSMSLFEVDQTKIQYVIRAQLHVGAKQENWNADIKTLKFDALSGSQEAEFTGYGKATLECQVQTAVDFSNSYIAEMEKESWIVDRQWAQDLTLPWQSGSGGVWREMHHLVEFEPPHAATIKVLALGNQEGSLKTALTGAMRVTKDTNGSNLYKLHGGHVSCRVKLSALTLKGTSYKMCTDKMSFVKNPTDTGHGTAVMQVKVPKGAPCRIPVMVADDLTASVNKGILVTVNPIASTNEDEVLIEVNPPFGDSYIIVGTGDSRLTYQWHKEGSSIGKLFTQTMKGAERLAVMGDAAWDFSSAGGFFTSVGKGIHMVFGSAFQGLFGGLSWITKVIMGAVLIWVGINMRNMTMSMSMILVGVIMMFLSLGVGADQGCAINFGK

SEQ ID NO: 543 - protein, 697 aa, synthetic construct
  REGION 1..697: note = derived and/or modified protein sequence (wt) from YFV__U21055__X-SS-prME-XX
MRGLSSRKRRSHDVLTVQFLILGMLLMTGGVTLVRKNRWLLLNVTSEDLGKTFSMGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDGPVEARKVCYNAVLTHVKINDKCPSTGEAHLAEENEGDNACKRTYSDRGWGNGCGLFGKGSIVACAKFTCAKSMSLFEVDQTKIQYVIRARLHVGAKQENWKTDIKTLKFDALSGSQEAEFTGYGKATLECQVQTAVDFGNSYIAEMEKESWIVDRQWAQDLTLPWQSGSGGVWREMHHLVEFEPPHAATIRVLALGDQEGSLKTALTGAMRVTKDTNDNNLYKLHGGHVSCRVKLSALTLKGTSYKMCTDKMSFVKNPTDTGHGTVVMQVKVPKGAPCRIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLNWITKVIIGAVLIWVGINTRNMTMSMSMILVGVIMMFLSLGVGADQGCAINFAK

SEQ ID NO: 544 - protein, 697 aa, synthetic construct
  REGION 1..697: note = derived and/or modified protein sequence (wt) from YFV__U21056__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWRGMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCRIPVIVADDLTAAINKGILVTVNPIASTNDDEVLIEVNPPFGDSYIIVGTGDSRLTYQWHKEGSSIGKLFTQTMKGVERLAVMGDAAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 545 - protein, 697 aa, synthetic construct
  REGION 1..697: note = derived and/or modified protein sequence (wt) from YFV__U54798__X-SS-prME-XX
MRGLSSRKRRSHDVLTVQFLILGMLLMAGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALAIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECRVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTDHGTVVMQVKVPKGAPCKIPVIVADDLTAAINKGILVTVNPIASTNDDEVLIEVNPPFGDSYIIVGTGDSRLTYQWHKEGSSIGKLFTQTMKGAERLAVMGDAAWDFSSAGGLFTSIGKGSHTVFGSAFQGLFGGLSWITKVIMGAVLIWVGINTRNMTMSMSMILVGVIMMFLSLGVGADQGCAINFGK

SEQ ID NO: 546 - protein, 687 aa, synthetic construct
  REGION 1..687: note = derived and/or modified protein sequence (wt) from YFV__AF052440__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWTTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 547 - protein, 697 aa, synthetic construct
  REGION 1..697: note = derived and/or modified protein sequence (wt) from YFV__AF052445__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGVVLIWVGINTRNMTMSMSMIMVGVIMMFLSLGVGADQGCAINFGK

SEQ ID NO: 548 - protein, 697 aa, synthetic construct
  REGION 1..697: note = derived and/or modified protein sequence (wt) from YFV__AF094612__X-SS-prME-XX
MRGLSSRKRRSHDVLTVQFLILGMLLMTGGVTLMRKNRWLLLNVTSEDLGKTFSIGTGNCTTNILEAKYWCPDSMEYNCPNLSPREEPDDIDCWCYGVENVRVTYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGVADRDFIEGVHGGTWVSATLEQDKCVTVMAPDKPSLDISLETVAIDGPVEARKVCYNAVLTHVKIDDKCPSTGEAHLAEENEGDNACKRTYSDRGWGNGCGLFGKGSIVACAKFTCAKSMSLFEVDQTKIQYVIKAQLHVGAKQEDWKTDIKTLKFDVLSGSQEAEFTGYGKVTLECQVQTAVDFGNSYIAEMEKESWIVDRQWAQDLTLPWQSGSGGVWREMHHLVEFEPPHAATIRVLALGDQEGSLKTALTGAMRVTKDTNDNNLYKLHGGHVSCRVKLSALTLKGTSYKMCTDKMSFVKNPTDTGHGTVVMQVKVPKGAPCKIPVIVADDLTAAINKGILVTVNPIASTNDDEVLIEVNPPFGDSYIIIGTGDSRLTYQWHKEGSSIGKLFTQTMKGAERLAVMGDAAWDFSSAGGFFTSVGKGIHTVFGSAFQGLFGGLNWITKVIMGAVLIWVGFNTRNMTMSMSMILVGVIMMFLSLGVGADQGCAINFGK

SEQ ID NO: 549 - protein, 697 aa, synthetic construct
  REGION 1..697: note = derived and/or modified protein sequence (wt) from YFV__KF769015__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWTTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 550 - protein, 697 aa, synthetic construct
  REGION 1..697: note = derived and/or modified protein sequence (wt) from YFV__KF769016__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCKIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 551 - protein, 697 aa, synthetic construct
  REGION 1..697: note = derived and/or modified protein sequence (wt) from YFV__KF907504__X-SS-prME-XX
MRGLSSRKRRSHEVLTVQFLILGMLLMTGGVTLVRKSRWLLLNVTSEDLGKTFSVGTGNCTTNILEAKNWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALAIAYLVGSNMTQRVVIALLVLAVGPAYSAHCIGITDRDFIEGVHGGTWVSATLEQDKCVTVMAPDKPSLDISLETVAIDGPAEARKVCYSAVLTHVKINDKCPSTGEAHLAEENEGDHACKRTYSDRGWGNGCGLFGKGSIVACAKFTCAKSMSLFEVDQTKIQYVIRAQLHVGAKQENWNADIKTLKFDALSGSQEAEFTGYGKATLECQVQTAVDFSNSYIAEMEKESWIVDRQWAQDLTLPWQSGSGGVWREMHHLVEFEPPHAATIKVLALGNQEGSLKTALTGAMRVTKDTNGSNLYKLHGGHVSCRVKLSALTLKGTSYKMCTDKMSFVKNPTDTGHGTAVMQVKVPKGAPCRIPVMVADDLTASVNKGILVTVNPIASTNEDEVLIEVNPPFGDSYIIVGTGDSRLTYQWHKEGSSIGKLFTQTMKGAERLAVMGDAAWDFSSAGGFFTSVGKGIHMVFGSAFQGLFGGLSWITKVIMGAVLIWVGINMRNMTMSMSMILVGVIMMFLSLGVGADQGCAINFGR

SEQ ID NO: 552 - protein, 697 aa, synthetic construct
  REGION 1..697: note = derived and/or modified protein sequence (wt) from YFV__JF912179__X-SS-prME-XX
MRGLSSRKRRSQDALTVQFLILGMLLMVGGVTLVRRNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFSK

SEQ ID NO: 553 - protein, 697 aa, synthetic construct
  REGION 1..697: note = derived and/or modified protein sequence (wt) from YFV__JF912180__X-SS-prME-XX
MRGLSSRKRRSQDVLTVQFLILGMLLMVGGVTLVRRNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVSCRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 554 - protein, 697 aa, synthetic construct
  REGION 1..697: note = derived and/or modified protein sequence (wt) from YFV__JF912181__X-SS-prME-XX
MRGLSSRKRRSHEVLTVHFLILGMMLMTGGVTLVRKSRWLLLNVTSEDLGKTFSVGTGNCTTNILDAKNWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALAIAYLVGSNMTQRVVIALLVLAVGPAYSAHCIGITDRDFIEGVHGGTWVSATLEQDKCVTVMAPDKPSLDISLETVAIDGPAEARKVCYSAVLTHVKINDKCPSTGEAHLAEENEGDNACKRTYSDRGWGNGCGLFGKGSIVACAKFTCAKSMSLFEVDQTKIQYVIRAQLHVGAKQENWNADIKTLKFDALSGSQEAEFTGYGKATLECQVQTAVDFSNSYIAEMEKESWIVDRQWAQDLTLPWQSGSGGVWREMHHLVEFEPPHAATIKVLALGNQEGSLKTALTGAMRVTKDANGSNLYKLHGGHVSCRVKLSALTLKGTSYKMCTDKMSFVKNPTDTGHGTAVMQVKVPKGAPCRIPVMVADDLTAAVNKGILVTVNPIASTNEDEVLIEVNPPFGDSYIIVGTGDSRLTYQWHKEGSSIGKLFTQTMKGAERLAVMGDAAWDFSSAGGFFTSVGKGIHMVFGSAFQGLFGGLSWITKVIIGAVLIWVGINMRNMTMSMGMILVGVIMMFLSLGVGADQGCAINFGK

SEQ ID NO: 555 - protein, 697 aa, synthetic construct
  REGION 1..697: note = derived and/or modified protein sequence (wt) from YFV__JF912182__X-SS-prME-XX
MRGLSSRKRRSQDVLTVQFLILGMLLMVGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFACAKSMSLFEVDQTKIQYVIRAQLHVGAKQENWNTDIKTLKFDALSGSQEAEFTGYGRATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 556 - protein, 697 aa, synthetic construct
  REGION 1..697: note = derived and/or modified protein sequence (wt) from YFV__JF912183__X-SS-prME-XX
MRGLSSRKRRSQDVLTVQFLILGMLLMVGGVTLVRRNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 557 - protein, 697 aa, synthetic construct
  REGION 1..697: note = derived and/or modified protein sequence (wt) from YFV__JF912184__X-SS-prME-XX
MRGLSSRKRRSQDALTVQFLILGMLLMVGGVTLVRRNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFSNSYIAEREKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 558 - protein, 697 aa, synthetic construct
  REGION 1..697: note = derived and/or modified protein sequence (wt) from YFV__JF912185__X-SS-prME-XX
MRGLSSRKRRSQDVLTVQFLILGMLLMVGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGRATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 559 - protein, 697 aa, synthetic construct
  REGION 1..697: note = derived and/or modified protein sequence (wt) from YFV__JF912186__X-SS-prME-XX
MRGLSSRKRRSQDVLTVQFLILGMLLMVGGVTLVRRSRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 560 - protein, 697 aa, synthetic construct
  REGION 1..697: note = derived and/or modified protein sequence (wt) from YFV__JF912187__X-SS-prME-XX
MRGLSSRKRRSQDVLTVQFLILGMLLMVGGVTLVRRNRWLLLNVTSEDLGKTFSVGTGNCTTNILEAKYWCSDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGRATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 561 - protein, 697 aa, synthetic construct
  REGION 1..697: note = derived and/or modified protein sequence (wt) from YFV__JF912189__X-SS-prME-XX
MRGLSSRKRRSQDVLTVQFLILGMLLMVGGVTLVRRNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGVKQENWNTDIKTLKFDALSGSQEAEFTGYGRATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 562 - protein, 687 aa, synthetic construct
  REGION 1..687: note = derived and/or modified protein sequence (wt) from YFV__AH005112__X-SS-prME-XX
MRGLSSRKRRSHDVLTVQFLILGMLLMAGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKTMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCKIPVIVADDLTAAINKGILVTVNPIASTNDDEVLIEVNPPFGDSYIIVGTGDSRLTYQWHKEGSSIGKLFTQTMRGQERLAVMGDTAWDFSSAGGFFTSIGKGIHTVFGSAFQGLFGGLSWITKVIMGAVLIWVGINTRNMTMSMSMILVGVIMMFLSLGVGA

SEQ ID NO: 563 - protein, 697 aa, synthetic construct
  REGION 1..697: note = derived and/or modified protein sequence (wt) from YFV__FJ654700__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFTGYGKATLECQVQTAVDFGNSYIAEMETESWIVDRQWAQDLTLPWQSGSGGVWREMHHLVEFEPPHAVTIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 564 - protein, 697 aa, synthetic construct
  REGION 1..697: note = derived and/or modified protein sequence (wt) from YFV__KM388817__X-SS-prME-XX
MRGLSSRKRRSQDVLTVQFLILGMLLMAGGVTLVRRNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALTIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGRATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 565 - protein, 697 aa, synthetic construct
  REGION 1..697: note = derived and/or modified protein sequence (wt) from YFV__HM582851__X-SS-prME-XX
MRGLSSRKRRSQDVLTVQFLILGMLLMVGGVTLVRRNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAATALAIAYLVGSNMTQRVVIALLVLAVGPAYSAHCIGITDRDFIEGVHGGTWVSATLEQDKCVTVMAPDKPSLDISLETVAIDGPAEARKVCYSAVLTNVKINDKCPSTGEAHLEEENEGDNACKRTYSDRGWGNGCGLFGKGSIVACAKFTCAKSMSLFEVDQTKIQYVIRAQLHVGAKQENWNTDIKTLKFDALSGSQEAEFTGYGRATLECQVQTAVDFSNSYIAEMEKESWIVDKQWAQDLTLPWQSGSGGVWREMHHLVEFEPPHAATIKVLALGNQEGSLKTALTGAMRVTKDTNNSKLYKLHGGHVACRVKLSALTLKGTSYKMCTDKMSFVKNPTDTGHGTAVMQVKVPKGAPCRIPVMVADDLTAAVNKGILVTVNPIASTNDDEVLIEVNPPFGDSYIIVGTGDSRLTYQWHKEGSSIGKLFTQTMKGAERLAVMGDAAWDFGSAGGFFTSVGKGIHTVFGSAFQGLFGGLSWITKVIMGVVLIWVGINTRNMTMSMSMILVGVIMMFLSLGVGADQGCAINFGK

SEQ ID NO: 566 - protein, 697 aa, synthetic construct
  REGION 1..697: note = derived and/or modified protein sequence (wt) from YFV__JN620362__X-SS-prME-XX
MRGLSSRKRRSNEMTMMPLLILSMVILAGGVTLVRKNRWLLLNVTAEDLGKTFSVGTGNCTTNILEAKYWCPDSMEYNCPNLSPREEPDDIDCWCYGVENVRVAYGRCDAVGRSKRSRRAIDLPTHENHGLKTRQEKWMTGRMGERQLQKIERWLVRNPFFAITALAIAYLVGNNMTQRVVIALLVLAVGPAYSAHCIGITDRDFIEGVHGGTWVSATLEQDKCVTVMAPDKPSLDISLQTVAIDGPAEARKVCYSAVLTHVKINDKCPSTGEAHLAEENDGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKDSWIVDRQWAQDLTLPWQSGSGGIWREMHHLVEFEPPHAATIRVLALGNQEGSLKTALTGAMRVTKDENDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAVNFGK

SEQ ID NO: 567 - protein, 697 aa, synthetic construct
  REGION 1..697: note = derived and/or modified protein sequence (wt) from YFV__JN811142__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWTTDIKTLRFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 568 - protein, 697 aa, synthetic construct
  REGION 1..697: note = derived and/or modified protein sequence (wt) from YFV__DQ100292__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVPKGAPCRIPVIVADDLTAAVNKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 569 - protein, 697 aa, synthetic construct; identical to SEQ ID NO: 48
  REGION 1..697: note = derived and/or modified protein sequence (wt) from YFV__DQ118157__X-SS-prME-XX

SEQ ID NO: 570 - protein, 697 aa, synthetic construct
  REGION 1..697: note = derived and/or modified protein sequence (wt) from YFV__DQ235229__X-SS-prME-XX
MIGLSSRKRRSNEMAMMPLLILSMVILAGGVTLVRKNRWLLLNVTAEDLGKTFSLGTGNCTTNILEAKYWCPDSMEYNCPNLSPREEPDDIDCWCYGVENVRVAYGRCDAVGRSKRSRRAIDLPTHENHGLKTRQEKWMAGRMGERQLQKIERWLVRNPFFAITALAIAYLVGNNMTQRVVIALLVLAVGPAYSAHCIGITDRDFIEGVHGGTWVSATLEQGKCVTVMAPDKPSLDISLQTVAIDGPAEARKVCYSAVLTHVKINDKCPSTGEAHLAEENDGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKDSWIVDRQWAQDLTLPWQSGSGGIWREMHHLVEFEPPHAATIRVLALGNQEGSLKTALTGAMRVTKDENDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAVNFGK

SEQ ID NO: 571 - protein, 696 aa, synthetic construct
  REGION 1..696: note = derived and/or modified protein sequence (wt) from YFV__DQ322633__X-SS-prME-XX
MGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 572 - protein, 689 aa, synthetic construct
  REGION 1..689: note = derived and/or modified protein sequence (wt) from YFV__DQ322634__X-SS-prME-XX
MRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 573 - protein, 687 aa, synthetic construct
  REGION 1..687: note = derived and/or modified protein sequence (wt) from YFV__DQ322642__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGAVLIWVGINTRNMTMSMSMILVGVIMMFLSLGVGA

SEQ ID NO: 574 - protein, 697 aa, synthetic construct
  REGION 1..697: note = derived and/or modified protein sequence (wt) from YFV__GQ379162__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTSIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVPKGAPCRIPVIVADDLTAAINKGILVTVNPIASTNDDEVLIEVNPPFGDSYIIVGRGDSRLTYQWHKEGSSIGKLFTQTMKGVERLAVMGDVAWDFSSAGGFFTSVGKGIHTVFGSAFQGLFGGLNWITKVIMGAVLIWVGINTRNMTMSMSMILVGVIMMFLSLGVGADQGCAINFGK

SEQ ID NO: 575 - protein, 695 aa, synthetic construct
  REGION 1..695: note = derived and/or modified protein sequence (wt) from YFV__DQ859065__X-SS-prME-XX
MLKGVSGRKKRRSVEATGFVSTLLFGIVLTASVSRHAHHTLLNVTKEDTNQILTLRNGNCTVVSMDVGSWCDDNVEYDCVTLQDNEEPDDVDCWCYKVNGVRVTYGKCREGNTPRRSKRAVVITAHLDQGLTTKKETWLGSSHFETQIQKIEKWIIRNPTYAIAAIIMAWYIGNSTKQRVVLLLLTLALGPAYATHCVGIAKRDFVQGVQGTTWVNVVMEQGACVTIVTEGKPSVDVWMEGITFSSPTMVRRISHTATISDTKISSACPSTGEAKLDEEHDKTFECKRTYSDRGWGNGCGLFGKGSIVACAKFTSTGHMDVYEMDMTKVEYTIKTQVHSGAKSDDTTGVKEIKFTPVSGTQTVEFPGYGNLGLECIVQSDIDFTTHYLVVLGTDAWLVHKAWVEDVTLPWKHEGAASWRDKQYLVEFGEPHAATIKVLVLGSQEGALRTALAGAMMVTHDSSAKTFKLHGGHVTCKAKLNDLVIKGTTYTNCRGGLSFVKTPTDTGHGTVVMQVKVSRNAPCRLTVIAADDASGHVNRGTLVTSNPIANSNNDEVLVEVNPPYGSSYLIVGTGDDKLVYQWKKSGSSIGKLFSETVKGAQRMAIVGSSSWDFSSAGGFFSSVGKALHTVFGTAFQGIFGGLSWITRVLIGVLLIWLGLNSRNGMATTVMMITGFVILFLSLGVGAEIGCSVNWGQ

SEQ ID NO: 576 - protein, 697 aa, synthetic construct
  REGION 1..697: note = derived and/or modified protein sequence (wt) from YFV__KU921608__X-SS-prME-XX
MRGLASRKRRSNEMALFPLLLLGLLALSGGVTLVRKNRWLLLNVTAEDLGKTFSVGTGNCTTNILEAKYWCPDSMEYNCPNLSPREEPDDIDCWCYGVENVRVAYGRCDAVGRSKRSRRAIDLPTHENHGLKTRQEKWMTGRMGERQLQKIERWLVRNPFFAVTALAIAYLVGNNTTQRVVIALLVLAVGPAYSAHCIGITDRDFIEGVHGGTWVSATLEQDKCVTVMAPDKPSLDISLQTVAIDGPAEARKVCYSAVLTHVKINDKCPSTGEAHLAEENDGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKDSWIVDRQWAQDLTLPWQSGSGGIWREMHHLVEFEPPHAATIRVLALGNQEGSLKTALTGAMRVTKDENDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAVNFGK

SEQ ID NO: 577 - protein, 697 aa, synthetic construct
  REGION 1..697: note = derived and/or modified protein sequence (wt) from YFV__KX010994__X-SS-prME-XX
MRGLSSRKRRSNEMAMFPLLLLGLLALSGGVTLVRKNRWLLLNVTAEDLGKTFSVGTGNCTTNILEAKYWCPDSMEYNCPNLSPREEPDDIDCWCYGVENVRVAYGRCDAVGRSKRSRRAIDLPTHENHGLKTRQEKWMTGRMGERQLQKIERWLVRNPFFAVTALAIAYLVGNNTTQRVVIALLVLAVGPAYSAHCIGITDRDFIEGVHGGTWVSATLEQDKCVTVMAPDKPSLDISLQTVAIDGPAEARKVCYSAVLTHVKINDKCPSTGEAHLAEENDGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKDSWIVDRQWAQDLTLPWQSGSGGIWREMHHLVEFEPPHAATIRVLALGNQEGSLKTALTGAMRVTKDENDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAVNFGK

SEQ ID NO: 578 - protein, 697 aa, synthetic construct
  REGION 1..697: note = derived and/or modified protein sequence (wt) from YFV__KX027336__X-SS-prME-XX
MRGLASRKRRSNEMAMVPLLLLGLLALSGGVTLVRKNRWLLLNVTAEDLGKTFSVGTGNCTTNILEAKYWCPDSMEYNCPNLSPREEPDDIDCWCYGVENVRVAYGRCDAVGRSKRSRRAIDLPTHENHGLKTRQEKWMTGRMGERQLQKIERWLVRNPFFAVTALAIAYLVGNNTTQRVVIALLVLAVGPAYSAHCIGITDRDFIEGVHGGTWVSATLEQDKCVTVMAPDKPSLDISLQTVAIDGPAEARKVCYSAVLTHVKINDKCPSTGEAHLAEENDGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKDSWIVDRQWAQDLTLPWQSGSGGIWREMHHLVEFEPPHAATIRVLALGNQEGSLKTALTGAMRVTKDENDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAVNFGK

SEQ ID NO: 579 - protein, 697 aa, synthetic construct
  REGION 1..697: note = derived and/or modified protein sequence (wt) from YFV__JX898868__X-SS-prME-XX
MRGLSSRKRRSHDALAVQFLILGMLLMAGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMMQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCKIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAINFGK

SEQ ID NO: 580 - protein, 697 aa, synthetic construct
  REGION 1..697: note = derived and/or modified protein sequence (wt) from YFV__JX898869__X-SS-prME-XX
MRGLSSRKRRSHDVLTVQFLILGMLLMAGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGAERLAVMGDAAWDFSSAGGFFTSIGKGIHTVFGSAFQGLFGGLSWITKVIMGAVLIWVGINTRNMTMSMSMILVGVIMMFLSLGVGADQGCAINFGK

SEQ ID NO: 581 - protein, 697 aa, synthetic construct
  REGION 1..697: note = derived and/or modified protein sequence (wt) from YFV__JX898873__X-SS-prME-XX
MRGLSSRKRRSHDALTVQLLILGMILMAGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGATRVTKDTNDNNLYKLHGGHVSCRVKLSALTLKGTSYKMCTDKMSFVKNPTDTGHGTVVMQVKVPKGAPCKIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAINFGK

SEQ ID NO: 582 - protein, 697 aa, synthetic construct
  REGION 1..697: note = derived and/or modified protein sequence (wt) from YFV__JX898874__X-SS-prME-XX
MRGLSSRKRRSHDALTVQLLILGMILMAGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCKIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAINFGK

SEQ ID NO: 583 - protein, 697 aa, synthetic construct
  REGION 1..697: note = derived and/or modified protein sequence (wt) from YFV__JX898875__X-SS-prME-XX
MRGLSSRKRRSHDALTVQLLILGMILMAGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWLVRNPFFAVTALTIAYLVGSNMTQRVVIALLVLAVGPAYSAHCIGITDRDFIEGVHGGTWVSATLEQDKCVTVMAPDKPSLDISLETVAIDGPAEARKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWNTDIKTLKFDALSGSQEAKFTGYGKATLECQVQTAVDFGNSYIAEMEKESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKMCTDKMSFVKNPTDTGHGTVVMQVKVPKGAPCKIPVIVADDLTAAINKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAINFGK

SEQ ID NO: 584 - protein, 697 aa, synthetic construct
  REGION 1..697: note = derived and/or modified protein sequence (wt) from YFV__JX949181__X-SS-prME-XX
MRGLSSRKRRSHDVLTVQFLILGMLLMTGGVTLVRKNRWLLLNVTSEDLGKTFSVGTGNCTTNILEAKYWCPDSMEYNCPNLSPREEPDDIDCWCYGVENVRVAYGKCDSAGRSRRSRRAIDLPTHENHGLKTRQEKWMTGRMGERQLQKIERWFVRNPFFAVTALTIAYLVGSNMTQRVVIALLVLAVGPAYSAHCIGITDRDFIEGVHGGTWVSATLEQDKCVTVMAPDKPSLDISLETVAIDRPAEVRKVCYNAVLTHVKINDKCPSTGEAHLAEENEGDNACKRTYSDRGWGNGCGLFGKGSIVACAKFTCAKSMSLFEVDQTKIQYVIRAQLHVGAKQENWTTDIKTLKFDALSGSQEVEFIGYGKATLECQVQTAVDFGNSYIAEMETESWIVDRQWAQDLTLPWQSGSGGVWREMHHLVEFEPPHAATIRVLALGNQEGSLKTALTGAMRVTKDTNDNNLYKLHGGHVSCRVKLSALTLKGTSYKICTDKMFFVKNPTDTGHGTVVMQVKVSKGAPCRIPVIVADDLTAAINKGILVTVNPIASTNDDEVLIEVNPPFGDSYIIVGRGDSRLTYQWHKEGSSIGKLFTQTMKGVERLAVMGDTAWDFSSAGGFFTSVGKGIHTVFGSAFQGLFGGLNWITKVIMGVVLIWVGINTRNMTMSMSMILVGVIMMFLSLGVGADQGCAINFGK

SEQ ID NO: 585 - protein, 697 aa, synthetic construct
  REGION 1..697: note = derived and/or modified protein sequence (wt) from YFV__AY968064__X-SS-prME-XX
MRGLSSRKRRSNEMALFPLLLLGLLALSGGVTLVRKNRWLLLNVTAEDLGKTFSVGTGNCTTNILEAKYWCPDSMEYNCPNLSPREEPDDIDCWCYGVENVRVAYGRCDAVGRSKRSRRAIDLPTHENHGLKTRQEKWMTGRMGERQLQKIERWLVRNPFFAVTALAIAYLVGNNTTQRVVIALLVLAVGPAYSAHCIGITDRDFIEGVHGGTWVSATLEQDKCVTVMAPDKPSLDISLQTVAIDGPAEARKVCYSAVLTHVKINDKCPSTGEAHLAEENDGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKDSWIVDRQWAQDLTLPWQSGSGGIWREMHHLVEFEPPHAATIRVLALGNQEGSLKTALTGAMRVTKDENDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGAERLAVMGDAAWDFSSAGGFFTSVGKGIHTVFGSAFQGLFGGLSWITKVIMGAVLIWVGINTRNMTMSMSMILVGVIMMFLSLGVGADQGCAVNFGK

SEQ ID NO: 586 - protein, 697 aa, synthetic construct
  REGION 1..697: note = derived and/or modified protein sequence (wt) from YFV__AY968065__X-SS-prME-XX
MRGLSSRKRRSSEMTMMPLLILSMVILGGGVTLVRKNRWLLLNVTAEDLGKTFSVGTGNCTTNILEAKYWCPDSMEYNCPNLSPREEPDDIDCWCYGVENVRVAYGRCDAVGRSKRSRRAIDLPTHENHGLKTRQEKWMTGRMGERQLQKIERWLVRNPFFAVTALAIAYLVGNNKTQRVVIALLVLAVGPAYSAHCIGITDRDFIEGVHGGTWVSASLEQDKCVTVMAPDKPSLDISLQTVAIDGPAEARKVCYSAVLTHVKINDKCPSTGEAHLAEENDGDNACKRTYSDRGWGNGCGLFGKGSIVACAKFTCAKSMSLFEVDQTKIQYVIRAQLHVGAKQENWNTDIKTLKFDALSGSQEAEFTGYGKATLECQVQTAVDFGNSYIAEMEKDSWIVDRQWAQDLTLPWQSGSGGIWREMHHLVEFEPPHAATIRVLALGNQEGSLKTALTGAMRVTKDENDNNLYKLHGGHVSCRVKLSALTLKGTSYKMCTDKMSFVKNPTDTGHGTVVMQVKVPKGAPCKIPVIVADDLTAAVNKGILVTVNPIASTNDDEVLIEVNPPFGDSYIIVGTGDSRLTYQWHKEGSSIGKLFTQTMKGVERLAVMGDAAWDFSSAGGFFTSVGKGIHTVFGSAFQGLFGGLSWITKVIMGAVLIWVGINTRNMTMSMSMILVGVIMMFLSLGVGADQGCAVNFGK

SEQ ID NO: 587 - RNA, 2061 nt, synthetic construct
  misc_feature 1..2061: note = derived and/or modified CDS sequence (wt) from YFV__L06480__X-SS-prME-XX
  source 1..2061: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccgagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacagctctgaccattgcctaccttgtgggaagcaacatgacgcaacgagtcgtgattgccctactggtcttggctgttggtccggcctactcagctcactgcattggaattactgacagggacttcattgagggggtgcatggaggaacttgggtttcagctaccctggagcaagacaagtgtgtcactgttatggcccctgacaagccttcattggacatctcactagagacagtagccattgatagacctgctgaggcgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccagcattaagactctcaagtttgatgccctgtcaggctcccaggaagtcgagttcattgggtatggaaaagctacactggaatgccaggtgcaaactgcggtggactttggtaacagttacatagctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgccaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacgtcgcctgggatttcagctccgctggagggttcttcacttcggttgggaaaggaattcatacggtgtttggctctgcctttcaggggctatttggcggcttgaactggataacaaaggtcatcatgggggcggtactcatatgggttggcatcaacacaagaaacatgacaatgtccatgagcatgatcttggtaggagtgatcatgatgtttttgtctctaggagttggggcg

SEQ ID NO: 588 - RNA, 2091 nt, synthetic construct
  misc_feature 1..2091: note = derived and/or modified CDS sequence (wt) from YFV__D14458__X-SS-prME-XX
  source 1..2091: mol_type = other RNA
atgagaggtttgtcctcgaggaaacgccgatcctatgaagtcttgactgttcaatttctaatcttgggaatgctgctgatgactggtggagtgaccctggtgcgcaagagcagatggttgcttttgaatgtcacatctgaggaccttgggaaaaccttctctgttggcacaggcaattgcacaaccaacattctggaggccaagaattggtgtccggattccatggaatacaactgccccaacctcagtccaagagaagagcctgatgacatagactgttggtgttatggagtggaaaatgttagggttgcttatggcaagtgtgattcagcaggtaggtcaagaaggtctagaagggccattgatttacccacacatgaaaaccatggtttgaagactcggcaagaaaagtggatgactggaagaatgggcgagagacaattgcagaaaattgaaagatggctagtgaggaaccccttttttgcggtgacagccttggctattgcttatttagtggggagcaacatgacgcaacgagttgtgattgctttgctagttttggctgttggcccagcttattcggctcactgcataggaataactgatagggatttcattgagggggtgcatggaggaacttgggtctcagccactttggaacaggacaagtgtgttactgtgatggcccctgacaagccctcattggacatatcactggaaacagttgccattgatggacctgctgaagcaaggaaagtgtgttacagtgcagtcttgacccatgtgaagatcaatgataagtgtcccagcaccggtgaagcccatttggccgaagaaaacgagggagatcacgcctgtaaacgaacttactctgacagaggctgggggaacggttgtggcctgtttggaaaaggaagcattgtggcatgtgccaaattcacctgtgctaagtccatgagcctgtttgaggttgaccagaccaaaatccagtatgtcattagggcacagctgcatgttggagccaagcaggagaactggaatgctgatattaagactctcaaatttgatgccctgtcaggttctcaggaggctgagttcactggatacgggaaggccacactggagtgccaagtacagaccgcagtggactttagcaacagctacattgcagagatggagaaagagagctggattgtggatagacagtgggctcaagatttgaccctaccttggcagagtggaagtggcggtgtgtggagagagatgcaccatcttgtggaattcgagcctccacatgctgcaactatcaaagtgttggcccttggaaaccaagaaggctctctgaagacagctctcactggtgcaatgcgggtcacaaaggacacaaatggcagcaacttgtacaagctgcatggggggcacgtctcatgtagagtgaaattgtcagctttgacactcaagggaacgtcttacaagatgtgtaccgataaaatgtcttttgtcaagaatccaactgatactggacatggcactgccgtgatgcaggtaaaagtgccaaaaggagccccctgcaggatcccagtgatggtagctgatgatctcacagcgtcagtcaacaaaggcattttagtcacagtcaatccaatagcctccactaatgaggatgaggtgttgattgaggtgaacccccccttcggggatagctatatcatagttgggacaggggactctcgcctgacctaccagtggcacaaggagggcagctcaatagggaagttgttcactcagaccatgaagggcgcggagcgcttggccgttatgggggatgctgcttgggacttcagctctgctggaggatttttcacatcagtcggaaagggaatacacatggtgtttggctctgcctttcagggactgtttggtggcctgagttggataacaaaggtcatcatgggggcagtccttatatgggttggcatcaacatgaggaacatgacaatgtctatgagcatgatcctggttggagtcatcatgatgtttctgtccctaggagtgggggcggaccaaggatgtgcaatcaactttggcaag

SEQ ID NO: 589 - RNA, 2091 nt, synthetic construct
  misc_feature 1..2091: note = derived and/or modified CDS sequence (wt) from YFV__U21055__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctatgggcacaggcaactgcacaacaaacattttggaagccaagtactggtgcccagactcaatggaatacaactgtcccaatctcagtccaagagaggagccagatgacattgattgctggtgctatggggtggaaaacgtcagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacagctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtctcagccaccctggagcaagacaagtgtgtcactgttatggcccctgacaagccttcattggacatctcactagagacagtagccattgatggacctgttgaggcgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaaggaagcattgtggcatgcgccaaattcacttgtgccaaatccatgagtttgtttgaggttgatcagaccaaaattcagtatgtcatcagagcacgattgcatgtaggggccaagcaggaaaattggaaaaccgacattaagactctcaagtttgatgccctgtcaggctcccaggaagccgagttcactgggtatggaaaagctacactggaatgccaggtgcaaactgcggtggactttggtaacagttacatcgctgagatggaaaaagagagctggatagtggacagacagtgggcccaggacttgaccctgccatggcagagtggaagtggcggggtgtggagagagatgcatcatcttgtcgaatttgaacctccgcatgccgccactatcagagtactggccctgggagaccaggaaggctccttgaaaacagctcttaccggcgcaatgagggttacaaaggacacaaatgacaacaacctttacaaactacatggtggacatgtttcctgcagagtgaaattgtcagctttgacactcaaggggacatcctacaaaatgtgcactgacaaaatgtcttttgtcaagaacccaactgacactggccatggcactgttgtgatgcaggtgaaagtgccaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggacaggagattcacgtctcacttaccagtggcacaaagagggaagctcaataggaaagttgttcactcagaccatgaaaggcgcggaacgcctggccgtcatgggagacgccgcctgggatttcagctccgctggagggttcttcacttcggttgggaaaggaattcatacggtgtttggctctgcctttcaggggctatttggcggcttgaactggataacaaaggtcatcataggggcggtactcatatgggttggcatcaacacaagaaacatgacaatgtccatgagcatgatcttggtaggagtgatcatgatgtttttgtccctaggagttggggcggatcaaggatgcgccatcaactttgccaag

SEQ ID NO: 590 - RNA, 2091 nt, synthetic construct
  misc_feature 1..2091: note = derived and/or modified CDS sequence (wt) from YFV__U21056__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggctcgtgaggaaccccttttttgcagtgacagctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatggacctgctgaggcgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagccgagttcactgggtatggaaaagctacactggaatgccaggtgcaaactgcggtggactttggtaacagttacatcgctgagatggaaaaagagagctggatagtggacagacagtgggcccaggacttgaccctgccatggcagagtggaagtggcggggtgtggagagggatgcatcatcttgtcgaatttgaacctccgcatgccgccactatcagagtactggccctgggaaaccaggaaggctccttgaaaacagctcttaccggcgcaatgagggttacaaaggacacaaatgacaacaacctttacaaactacatggtggacatgtttcctgcagagtgaaattgtcagctttgacactcaaggggacatcctacaaaatgtgcactgacaaaatgtcttttgtcaagaacccaactgacactggccatggcactgttgtgatgcaggtgaaagtgccaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggacaggagattcacgtctcacttaccagtggcacaaagagggaagctcaataggaaagttgttcactcagaccatgaaaggcgtggaacgcctggccgtcatgggagacgccgcctgggatttcagctctgctggagggttcttcacttcggttgggaaaggaattcatacggtgtttggctctgcctttcaggggctatttggcggcttgaactggataacaaaggtcatcatgggggcggtactcatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 591 - RNA, 2091 nt, synthetic construct
  misc_feature 1..2091: note = derived and/or modified CDS sequence (wt) from YFV__U54798__X-SS-prME-XX
  source 1..2091: mol_type = other RNA
atgagagggttgtcttcaaggaaacgccgctcccatgatgtcttgactgtgcaatttctgattctgggaatgctgctgatggcgggtggagttaccttggtgcggaaaaacagatggctactcttaaatgtgacatctgaggaccttgggaagaccttttctgtgggcacaggcaactgtacaacaaacattctagaagccaagtactggtgccccgattcaatggaatacaactgtcccaatcttagcccaagagaggagcctgatgacatcgattgctggtgttacggagtggaaaatgttagagttgcatatggtaagtgtgactcagcaggcaggtcgaggaggtcaagaagagccattgatttgcccacgcatgaaaaccatggcctgaaaactcggcaagaaaaatggatgactggaagaatgggggagaggcaactccaaaagattgagagatggcttgtgaggaatcccttctttgcagtaacagccctggccatcgcctaccttgtgggcagcaacatgacacaacgagtcgtgattgccctgctggttttggctgttggcccggcttactcagctcactgcattggaatcactgacagggatttcattgagggggtgcacggaggaacctgggtttcagccaccttggagcaagacaagtgtgtcactgtcatggcccctgacaagccttcactggacatctcactggagacagtggccattgatggacctgctgaggcaagaaaagtgtgttacaatgcagtccttacccatgtgaagatcaatgacaagtgccctagcactggtgaggcccatttagctgaagagaatgagggggataatgcgtgtaagcgcacctattcggacagaggctggggaaacggctgtggcctgtttgggaagggaagcattgtggcatgcgccaagttcacttgtgccaagtccatgagcttgtttgaggttgaccagacaaagatccagtacgtcatcagagcacaattacatgttggggcaaagcaggaaaattggaataccgatatcaaaactctcaagtttgatgcgttgtcaggctctcaggaagccgagtttactgggtatggaaaagctactctggaatgccgggtgcagactgcagtagactttggcaacagttacattgctgagatggagaaagagagttggatagtggacaggcaatgggcccaggatctaaccttaccatggcagagcggtagcggcggggtgtggagagaaatgcaccatcttgttgaatttgaaccccctcacgccgcaaccatcagagtgttagccctaggaaaccaggaaggctctttgaaaacagcccttacaggtgcaatgagggtcacaaaggacaccaatgataacaatctgtacaaactacatggtggacatgtttcctgtagagtgaaactgtcagctttaacactcaaggggacatcctacaaaatgtgcacagataaaatgtcctttgtcaagaacccgactgacactgaccatggcactgttgtgatgcaggtgaaagtgccaaaaggagctccctgcaagatcccagtgatagtggctgatgatcttacagcagcaatcaataaaggcattttggttacagttaaccccatcgcctcaaccaatgatgatgaagtgctgattgaggtgaatccaccctttggagatagttacatcatagttggaacgggagattcacgtcttacttatcagtggcacaaagaggggagttcaataggaaagctgtttacccagaccatgaaaggcgcagaacgcctggctgttatgggagacgctgcctgggattttagctctgctggggggctcttcacttcgattgggaaaggaagtcacacggtgtttggctctgcctttcagggattgtttggtggcttgagctggataacgaaggtcattatgggcgcggtcctcatatgggttggcatcaacacaagaaacatgacaatgtccatgagtatgatcttggtgggagtgatcatgatgttcttgtctctgggagttggggcggatcaaggatgtgcaatcaactttggtaag

SEQ ID NO: 592 - RNA, 2061 nt, synthetic construct
  misc_feature 1..2061: note = derived and/or modified CDS sequence (wt) from YFV__AF052440__X-SS-prME-XX
  source 1..2061: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggactaccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 593 - RNA, 2091 nt, synthetic construct
  misc_feature 1..2091: note = derived and/or modified CDS sequence (wt) from YFV__AF052445__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggtggtacttatatgggttggcatcaacacaagaaacatgacaatgtccatgagcatgatcatggtaggagtgatcatgatgtttttgtctctaggagttggggcggatcaaggatgcgccatcaactttggcaag

SEQ ID NO: 594 - RNA, 2091 nt, synthetic construct
  misc_feature 1..2091: note = derived and/or modified CDS sequence (wt) from YFV__AF094612__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttgatgcggaagaatagatggttgctcctaaatgtgacatctgaggacctcgggaaaacattctctataggcacaggcaactgcacaacaaacattttggaagccaagtactggtgcccagactcaatggaatacaactgtcccaatctcagtccaagagaggagccagatgacattgattgctggtgttatggagtggagaacgttagagtcacatatggtaagtgtgactcagcaggcaggtctaggaggtcaagaagggccattgacttgcctacgcatgaaaatcatggtttgaagacccggcaagaaaaatggatgactggaagaatgggtgaaaggcaactccaaaagatcgagagatggttcgtgaggaaccccttttttgcagtgacagctctgaccattgcctaccttgtgggaagcaacatgacgcaacgagtcgtgattgccctactggtcttggctgttggtccggcctactcagctcactgcattggagttgctgacagggatttcattgagggggtgcatggaggaacttgggtctcagccaccctggagcaagacaagtgtgtcactgttatggcccctgacaagccttcattggacatctcactagagacagtagccattgatggacctgttgaggcgaggaaagtgtgttacaatgcagttctcactcatgtgaagattgatgacaagtgccccagcactggagaggcccacctagctgaagagaacgaaggggacaatgcgtgcaagcgcacttattctgatagaggctggggcaatggctgtggcctatttgggaaaggaagcattgtggcatgcgccaaattcacttgtgccaaatccatgagtttgtttgaggttgatcagaccaagattcagtatgttatcaaagcacaattgcatgtaggggccaagcaggaagattggaaaaccgacattaagactctcaagtttgatgtcctgtcaggctcccaggaagccgagttcactgggtatggaaaagttacactggaatgccaggtgcaaactgcggtggactttggtaacagttacatcgctgagatggaaaaagagagctggatagtggacagacagtgggcccaggacttgaccctgccatggcagagtggaagtggcggggtgtggagagagatgcatcatcttgtcgaatttgaacctccgcatgccgccactatcagagtactggccctgggagaccaggaaggctccttgaaaactgctcttaccggcgcaatgagggttacaaaggacacaaatgacaacaacctttacaaactacatggtggacatgtttcttgcagagtgaaattgtcagctttgacactcaaggggacatcctacaaaatgtgcactgacaaaatgtcttttgtcaagaacccaactgacactggtcatggcactgttgtgatgcaggtgaaagtgccaaaaggagccccctgcaagattccagtgatagtagctgatgaccttacagcggcaatcaataaaggcattttggttacagttaaccccatcgcctcaaccaatgatgatgaagtgctgattgaggtgaacccaccttttggagatagctacattatcattgggacaggagattcacgtctcacttaccagtggcacaaagagggaagctcaataggaaagttgttcactcagaccatgaaaggcgcggaacgcctggccgtcatgggagacgccgcctgggatttcagctccgctggagggttcttcacctcggttgggaaaggaattcatacggtgtttggctctgcctttcaggggctatttggtggcttgaactggataacaaaggtcatcatgggggcggtactcatatgggttggcttcaacacaagaaacatgacaatgtccatgagcatgatcctggtaggagtgatcatgatgtttttgtctctaggagttggggcggatcaaggatgcgccatcaactttggcaag

SEQ ID NO: 595 - RNA, 2091 nt, synthetic construct
  misc_feature 1..2091: note = derived and/or modified CDS sequence (wt) from YFV__KF769015__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggactaccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 596 - RNA, 2091 nt, synthetic construct
  misc_feature 1..2091: note = derived and/or modified CDS sequence (wt) from YFV__KF769016__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggctcgtgaggaaccccttttttgcagtgacagctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatggacctgctgaggcgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagccgagttcactgggtatggaaaagctacactggaatgccaggtgcaaactgcggtggactttggtaacagttacatcgctgagatggaaaaagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttaccggcgcaatgagggttacaaaggacacaaatgacaacaacctttacaaactacatggtggacatgtttcctgcagagtgaaattgtcagctttgacactcaaggggacatcctacaaaatgtgcactgacaaaatgtcttttgtcaagaacccaactgacactggccatggcactgttgtgatgcaggtgaaagtgccaaaaggagccccctgcaagattccagtgatagtagctgatgatcttacagcggcaatcaataaaggcattttggttacagttaaccccatcgcctcaaccaatgatgatgaagtgctgattgaggtgaacccaccttttggagacagctacattatcgttgggacaggagattcacgtctcacttaccagtggcacaaagagggaagctcaataggaaagttgttcactcagaccatgaaaggcgcggaacgcctggccgtcatgggagacgccgcctgggatttcagctccgctggagggttcttcacttcggttgggaaaggaattcatacggtgtttggctctgcctttcaggggctatttggcggcttgaactggataacaaaggtcatcatgggggcggtactcatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 597 - RNA, 2091 nt, synthetic construct
  misc_feature 1..2091: note = derived and/or modified CDS sequence (wt) from YFV__KF907504__X-SS-prME-XX
  source 1..2091: mol_type = other RNA
atgagaggtttgtcctcgaggaaacgccgatcccatgaagtcttgactgttcagtttctgatcttgggaatgctgctgatgactggtggagtgaccctggtgcgtaagagcagatggttgcttttgaatgtcacatctgaggaccttgggaaaaccttctctgttggcacaggcaattgcacaaccaacattctggaggccaagaattggtgtccggattccatggaatacaactgccccaaccttagtccaagagaggagcctgatgacatagactgttggtgttatggagtggaaaatgttagggttgcttatggcaagtgtgattcagcgggtaggtcaagaaggtctagaagggccattgatttacccacacatgaaaaccatggtttgaagactcggcaagaaaagtggatgactggaagaatgggcgagagacaattgcagaaaattgaaagatggctagtgaggaaccccttctttgcggtgacagccttggctattgcttatttggtggggagcaacatgacgcaacgagttgtgattgctttgctagttttggctgttggcccagcttactcggctcactgcataggaataactgacagggatttcattgagggggtgcatggaggaacttgggtctcagccactttggaacaggacaagtgtgttactgtgatggcccctgacaagccctcattggacatatcactggaaacagttgccattgatggacctgctgaagcaaggaaagtgtgttacagtgcagtcttgacccatgtgaagatcaatgataagtgccccagcaccggtgaagcccatttggccgaagaaaacgagggagatcacgcctgtaaacgaacttactctgacagaggctgggggaacggctgtggcctgtttggaaaaggaagtattgtggcatgtgccaaattcacctgtgccaagtctatgagcctgtttgaggttgaccagaccaaaatccagtatgtcattagggcacagctgcatgttggagccaagcaggagaactggaatgctgatattaagactctcaaatttgatgccctgtcaggttctcaggaggctgagttcactggatatgggaaggccacactggagtgtcaagtacagacagcagtggactttagcaacagctacattgcagagatggagaaagagagctggattgtggatagacagtgggctcaggatttgaccctaccttggcagagtggaagtggcggtgtgtggagagagatgcaccatcttgtggaattcgagcctccacatgctgcaactatcaaagtgttggccctgggaaaccaagaaggctctctgaagacagctctcactggcgcaatgcgggtcacaaaggacacaaatggcagcaacctgtacaagctgcatggggggcacgtctcatgtagagtgaaattgtcagctttgacactcaagggaacatcctacaagatgtgtaccgataaaatgtcttttgtcaagaatccaacagacactggacatggcactgccgtgatgcaggtgaaagtgccaaagggagccccctgtaggatcccagtgatggtagctgatgacctcacggcgtcagtcaacaaaggcattttagtcacagtcaatccaatagcctccactaatgaggatgaggtgttgattgaggtgaacccccccttcggggacagctatatcatagttgggacgggggactctcgtctgacctaccagtggcacaaggagggcagctcaatagggaagttgttcactcagaccatgaagggcgcggagcgcctggccgttatgggggatgctgcatgggacttcagctctgctggaggatttttcacatcagttggaaaaggaatacacatggtgtttggttctgcctttcagggattgtttggtggcttgagttggataacaaaggtcatcatgggggcagtcctcatatgggttggcatcaacatgaggaacatgacaatgtctatgagtatgatcctggttggagtcatcatgatgtttctgtccctaggagtgggggcggaccaaggatgtgcaatcaactttggcagg

SEQ ID NO: 598 - RNA, 2091 nt, synthetic construct
  misc_feature 1..2091: note = derived and/or modified CDS sequence (wt) from YFV__JF912179__X-SS-prME-XX
  source 1..2091: mol_type = other RNA
atgagaggtttgtcctcgaggaaacgccgatctcaagatgctttgactgtgcaatttctgattctgggaatgctgctgatggttggtggagtgaccctggtgcgcagaaacagatggttacttctgaatgttacatctgaggaccttgggaaaaccttttctgttggcacaggtaactgcacaaccaacattctggaggccaaatactggtgtccagattccatggaatacaactgccccaatctcagtccaagagaagagcctgatgacatagattgttggtgctatggagtggaaaatgtcagagtcgcttacggcaagtgtgattcagcgggtaggtcaagaaggtccagaagggccattgacttgcccacacatgaaaatcatggcttaaagacccggcaagaaaagtggatgaccggaagaatgggtgagagacaactgcagaaaattgaaagatggctggtaaggaaccccttttttgcggcaacagccttggccattgcctacctggtggggagcaacatgacgcaacgagttgtcatagccctgctagtcttggctgttggcccagcctattcggctcactgtataggaataaccgacagggatttcattgagggggtgcatgggggaacctgggtttcagccaccttggaacaggacaagtgtgtcactgtgatggcccctgacaagccttcactggacatatcactagaaacagttgccattgatggacctgctgaagcaaggaaggtgtgctacagtgcagtcttaaccaatgtgaagatcaatgacaagtgccccagcactggtgaagcccatttggaagaagaaaatgaaggagacaatgcttgtaagcgaacttactctgatagaggctggggaaatggttgtggcctgtttggaaaaggaagcattgtggcatgtgccaagtttacctgtgctaaatccatgagtctatttgaggttgatcagaccaaaattcagtatgtcattagggcacagctacatgttggagccaagcaggagaattggaacactgacatcaaaactctcaagtttgatgccctgtcaggctctcaggaagctgagttcactggatacgggaaggccacactggagtgccaggttcagaccgcagtggacttcagcaatagttacattgcagagatggagaaagagagctggattgtggacaaacagtgggcccaagacttgaccctaccttggcagagtggaagtggcggcgtgtggagagagatgcatcatctcgtggaattcgagcctccacatgctgcaaccatcaaagtgttagctcttggaaaccaagaaggatccttgaagaccgctctcactggtgcaatgcgagttacaaaagacacaaataacagcaagctgtacaagctgcatggggggcacgtcgcgtgtagggtgaagttgtcagctctcacacttaagggaacatcctacaagatgtgtaccgacaaaatgtcctttgtcaagaatccaactgacactggacatggcactgcagtgatgcaagtgaaggtgccaaagggagcaccctgcagaatcccagtaatggttgccgatgatctcacagcggcagtcaacaagggcatcttggtcacagtcaatccaatagcctccactaatgatgatgaagtgttgatcgaggtgaaccctccctttggggacagctatatcatagttggaactggggattcacgcctgacttaccagtggcacaaggaaggtagctcaatagggaagttgttcacccagaccatgaagggcgcagagcgcctggccgtcatgggggatgctgcctgggactttggctccgctggaggattcttcacatcagtcggaaaaggaatacacactgtgtttggctctgccttccaaggattgtttggtggcttgagctggataacaaaggtcattatgggggtagtcctcatatgggttggcattaacacaaggaacatgacaatgtccatgagcatgatcctagttggagtcatcatgatgttcctgtccctaggagttggggcggaccaaggatgtgcaataaactttagcaag

SEQ ID NO: 599 - RNA, 2091 nt, synthetic construct
  misc_feature 1..2091: note = derived and/or modified CDS sequence (wt) from YFV__JF912180__X-SS-prME-XX
  source 1..2091: mol_type = other RNA
atgagaggtttgtcctcgaggaaacgccgatcccaagacgttctgactgtgcaatttctgattctgggaatgctgctgatggttggtggagtgaccttggtgcgcagaaacagatggttacttctgaatgttacatctgaggaccttgggaaaaccttttctgttggcacaggcaactgcacaaccaacattctggaggccaaatattggtgtccagattccatggaatacaactgccctaatctcagtccaagagaagagcctgatgacatagattgttggtgttatggagtggaaaatgtcagagtcgcttatggcaagtgtgattcagcgggtaggtcaagaaggtccagaagggccattgacttacccacacatgaaaatcatggcttaaagacccggcaagaaaagtggatgaccggaagaatgggcgagagacagctgcagaaaattgaaagatggctggtaaggaaccccttttttgcggcaacagccctggccattgcctacctggtggggagcaacatgacacaacgagttgtcatagccctgctagtcttggctgttggcccagcctattcggctcactgcataggaataaccgacagggatttcattgagggggtgcatgggggaacctgggtttcagccaccttggagcaggacaagtgtgtcactgtgatggcccctgacaagccttcactggacatatcactagaaacagttgccattgatggacctgctgaagcaaggaaggtgtgctacagtgcagtcttaaccaatgtgaagattaacgacaagtgccccagcactggtgaagcccacttggaagaagaaaatgaaggagacaatgcttgtaagcggacttactctgatagaggttggggaaatggttgtggcctgtttggaaaaggaagcattgtggcatgtgccaagtttacctgtgctaaatccatgagtctatttgaggttgatcagaccaaaattcagtatgtcattagggcacagctacatgtcggagccaagcaggagaattggaacactgacatcaaaactctcaagtttgatgccctgtcaggctctcaggaagctgagtttactggatacgggaaggccacactggagtgccaggtacagaccgcagtggacttcagcaacagttacattgcagagatggagaaagagagctggattgtggataaacagtgggcccaagacctgaccctaccctggcagagtggaagtggcggcgtttggagagagatgcatcatctcgtggaatttgagcctccacatgctgcaaccatcaaagtgttagcccttggaaaccaagaaggatccttgaagactgctctcactggtgcaatgcgagttacaaaagacacaaataacagcaagctatacaagttgcatggggggcacgtctcgtgtagggtgaagttgtcagctctcacacttaagggaacatcctacaagatgtgtaccgacaaaatgtcttttgtcaagaatccaactgacactggacatggcactgcagtgatgcaagtgaaggtgccaaagggagcaccctgcaggatcccagtgatggtcgccgatgatctcacagcggcagtcaacaagggcattttggtcacagtcaatccaatagcctccactaacgatgatgaagtgttgatcgaggtgaaccctccctttggggacagctacatcatagttggaacaggggattcacgcttgacttaccagtggcacaaggaaggcagctcaatagggaagttgttcacccagaccatgaagggcgcagagcgtctggctgtcatgggggatgctgcctgggactttggctctgctgggggattcttcacatcagtcggaaaaggaatacacactgtgtttggctctgccttccaaggattgtttggtggcttgagctggataacaaaggtcattatgggggtagtcctcatatgggttggcattaacacaaggaatatgacaatgtccatgagcatgatcctagttggagtcatcatgatgttcctgtccctaggagttggggcggaccaaggatgtgcaataaactttggcaag

SEQ ID NO: 600 - RNA, 2091 nt, synthetic construct
  misc_feature 1..2091: note = derived and/or modified CDS sequence (wt) from YFV__JF912181__X-SS-prME-XX
  source 1..2091: mol_type = other RNA
atgagaggtttgtcctcgaggaaacgccgatcccatgaagtcttgactgttcactttctgatccttggaatgatgctgatgactggtggagtgaccctggtgcgcaagagtagatggctgctcttgaatgtaacatctgaggaccttgggaaaaccttctctgttggcacaggcaattgcacaaccaacattctggatgccaagaattggtgtccggattccatggaatacaactgccccaacctcagtccaagagaagagcctgatgacatagattgttggtgttatggagtggaaaatgttagggttgcttatggcaagtgtgattcagcgggtaggtcaagaaggtctagaagggccattgacttacccacacatgaaaaccatggtttgaagactcggcaagaaaagtggatgactggaagaatgggcgagagacaattgcagaaaattgaaagatggctagtgaggaatcccttttttgcggtgacagccttagctattgcttatttagtggggagcaacatgacgcaacgagttgtgattgccttgctagttttggctgttggcccagcctattcggctcactgcataggaataactgatagggatttcattgagggggtgcatggaggaacttgggtctcagccaccttggaacaggacaagtgtgttactgtgatggcccctgacaagccctcattggacatatcattggaaacagttgccattgatggacctgctgaagcgaggaaagtgtgctacagtgcagtcttgacccatgtgaagatcaatgacaagtgccccagcaccggcgaagcccatttggccgaagaaaacgagggagataatgcctgtaaacggacttactctgacaggggctgggggaatggttgtggcctgtttgggaaaggaagcattgtggcatgtgccaagtttacctgtgccaagtccatgagcctgtttgaggttgaccagaccaaaatccagtatgtcatcagggcacaattgcatgttggagccaagcaggagaactggaatgctgacatcaagaccctcaaatttgatgccctgtcaggttctcaggaggctgagtttactggatacgggaaggctacattggagtgccaagtacagaccgcagtggactttagcaacagctacattgcagagatggagaaggagagctggattgtggatagacagtgggctcaagatttgaccctaccttggcagagtggaagtggtggtgtgtggagagagatgcaccatcttgtggaatttgagcctccacatgctgcaaccatcaaggtgttggccctgggaaaccaagaaggctctttgaagacagctctcactggtgcaatgcgggtcacaaaagacgcaaatggcagcaacctatacaagctccatggggggcacgtctcatgtagagtgaaattgtcagctttgacactcaagggaacatcctacaagatgtgtaccgataaaatgtcttttgttaagaatccaactgacactggacatggcactgccgtgatgcaggtgaaggtgccaaaaggagccccctgcaggatcccagtgatggtagctgatgatctcacagcggcagtcaacaaaggcattttagtcacagtcaacccgatagcctccaccaacgaggatgaagtgttgattgaggtgaacccccccttcggggacagctatattatagttgggacaggggactcccgcctgacctatcagtggcacaaggagggcagctcaataggaaagttgttcacccagaccatgaagggcgcggagcgcttggccgttatgggggatgctgcttgggacttcagctctgctggaggatttttcacatcagtcggaaaaggaatacacatggtgtttggttctgcctttcaaggattgtttggtggcctgagttggataacaaaggtcatcataggggcagtccttatatgggttggcatcaacatgaggaacatgacaatgtctatgggcatgatcctggttggagtcatcatgatgtttctgtccctgggagtgggggcggaccaaggatgtgcaatcaactttggtaag

SEQ ID NO: 601 - RNA, 2091 nt, synthetic construct
  misc_feature 1..2091: note = derived and/or modified CDS sequence (wt) from YFV__JF912182__X-SS-prME-XX
  source 1..2091: mol_type = other RNA
atgagaggtttgtcctcgaggaaacgccggtcccaagatgttttaactgtgcaatttctgattctgggaatgctgctgatggttggtggagtgaccttggtacgtaaaaacagatggttacttctgaatgttacatctgaggaccttgggaaaaccttttctgttggcacaggtaactgcacaaccaacattctggaggccaaatattggtgtccagattccatggaatataactgccctaatctcagtccaagagaagagcctgatgacatagactgctggtgttatggagtggaaaatgtcagagtcgcttatggcaagtgtgattcagctggtaggtcaagaaggtccagaagggccattgacttacccacacatgaaaatcatggcttaaagactcggcaggaaaagtggatgaccggaagaatgggcgagagacagctgcagaaaattgaaagatggctggtaaggaaccccttttttgcagcaacagccttggccattgcctacctggtggggagcaacatgacgcaacgagttgtcatagccctgctagtcttggctgttggcccagcctattcggctcactgtataggaataactgacagggacttcattgagggggtgcatgggggaacctgggtttcagccaccttggaacaggacaagtgtgtcactgtgatggcccccgacaagccttcactggacatatcactagaaacagttgccattgatggacctgctgaagcaaggaaggtgtgctacagtgcagtcttaaccaatgtgaagatcaatgacaagtgccccagcactggtgaagcccacctggaagaagaaaatgaaggagacaatgcttgtaagcgaacttactctgacagaggttggggaaatggttgtggcctgtttggaaaaggaagcattgtggcatgtgccaagtttgcctgtgctaaatccatgagtctatttgaggttgatcagaccaaaatccagtatgtcatcagggcacagctgcatgtcggagccaagcaggagaattggaatactgacatcaaaactctcaagtttgatgccctgtcaggatctcaggaagctgagttcactggatacgggagggccacactggagtgccaggtacagaccgcagtggacttcagcaatagttacatcgcagagatggagaaagagagctggattgtggataaacagtgggcccaagatctgaccctaccttggcagagtggaagtggcggcgtgtggagagagatgcatcatctcgtggaatttgaacctccacatgctgcaaccatcaaagtgttagcccttgggaaccaagaaggatccttgaagactgctctcactggtgcaatgcgagttacaaaagacacaaataacagcaagctgtacaagctgcatggggggcacgtcgcgtgtagggtgaagttgtcagctctcacacttaagggaacatcctacaagatgtgcaccgacaaaatgtcttttgtcaagaatccaactgacactggacatggcactgcagtgatgcaagtaaaggtgccaaagggggcaccctgcaggatcccagtgatggtcgccgatgatctcacagcggcagttaacaagggcattctggtcacagtcaatccaatagcctccactaacgacgatgaagtgttgatcgaggtgaaccctccctttggggacagctacatcatagttggaacaggggattcacgcttgacctaccagtggcacaaagaaggtagctcaatagggaagttgttcactcagaccatgaagggcgcggagcgcctggccgtcatgggggatgctgcctgggacttcggctctgctgggggtttcttcacatcagtcggaaaaggtatacacactgtgtttggttctgccttccaaggattgtttggtggcttgagctggataacaaaggtcatcatgggggtagtcctcatatgggttggcattaatacaaggaatatgacaatgtccatgagcatgatcctagttggagtcatcatgatgttcctgtccctaggagttggggcggaccaaggatgtgcaataaactttggcaag

SEQ ID NO: 602 - RNA, 2091 nt, synthetic construct
  misc_feature 1..2091: note = derived and/or modified CDS sequence (wt) from YFV__JF912183__X-SS-prME-XX
  source 1..2091: mol_type = other RNA
atgagaggtttgtcctcgaggaaacgccgatctcaagatgttttgactgtgcaatttctgattctgggaatgctgctgatggttggtggagtgaccctggtgcgcagaaacagatggttacttctgaatgttacatctgaggacctggggaaaaccttttctgttggcacaggtaactgcacaaccaacattctggaggccaaatactggtgtccagattccatggaatacaattgccccaatctcagtccaagagaagagcctgatgacatagattgttggtgttatggagtggaaaatgtcagagtcgcttacggcaagtgtgattcagcgggtaggtcaagaaggtccagaagggccattgacttgcccacacatgaaaatcatggcttaaagacccggcaagaaaagtggatgaccggaagaatgggtgagagacagctgcagaaaattgaaagatggctggtaaggaaccccttttttgcggcaacagccttggccattgcctacctggtggggagcaacatgacgcaacgagttgtcatagccctgctagtcctggctgttggcccagcctattcggctcactgtataggaataaccgacagggatttcattgagggggtgcatggaggaacctgggtttcagccaccttggaacaggacaagtgtgtcactgtgatggcccctgataagccttcactggatatatcactagaaacagttgccattgatggacctgctgaagcaaggaaggtgtgctacagtgcagtcttaaccaatgtgaagatcaatgacaagtgccccagcactggtgaagcccacttggaagaagaaaatgaaggagacaatgcttgtaagcgaacctactctgatagaggctggggaaatggttgtggcctgtttggaaaaggaagcattgtggcatgtgccaagtttacctgtgctaaatccatgagtctatttgaggttgatcagaccaaaattcagtatgtcattagggcacagctacatgttggagccaagcaggagaattggaacactgacatcaaaactctcaagtttgatgccctgtcaggctctcaggaagctgagttcactggatacgggaaggccacactggagtgccaggttcagaccgcagtggacttcagcaatagttacattgcagagatggagaaagagagctggattgtggacaaacagtgggcccaagacttgaccctaccttggcagagtggaagtggcggcgtgtggagagagatgcatcatctcgtggaattcgagcctccacatgctgcaaccatcaaagtgttagcccttggaaaccaagaaggatctttgaagaccgctctcactggtgcaatgcgagttacaaaagacacaaataacagcaagctgtacaagctgcatggggggcacgtcgcgtgtagggtgaagttgtcagctctcacacttaagggaacatcctacaagatgtgtaccgacaaaatgtcttttgtcaagaatccaactgacactggacatggcactgcagtgatgcaagtgaaggtgccaaagggagcaccctgcagaatcccagtaatggtcgccgatgatctcacagcggcagtcaacaagggtattttggtcacagtcaatccaatagcctccactaatgatgatgaagtgttgatcgaggtgaaccctccctttggggacagttatatcatagttggaactggggattcacgcttgacttaccagtggcacaaggaaggtagctcaatagggaagttgttcactcagaccatgaagggcgcagagcgcttggccgtcatgggggatgctgcctgggactttggctctgccggaggattcttcacatcagtcggaaaaggaatacacactgtgtttggctctgccttccaaggattgtttggtggcttgagctggataacaaaggtcattatgggggtagtcctcatatgggttggcattaacacaaggaatatgacaatgtccatgagcatgatcctagtaggagtcatcatgatgttcctgtccctaggagttggggcggaccaaggatgtgcaataaactttggcaag

SEQ ID NO: 603 - RNA, 2091 nt, synthetic construct
  misc_feature 1..2091: note = derived and/or modified CDS sequence (wt) from YFV__JF912184__X-SS-prME-XX
  source 1..2091: mol_type = other RNA
atgagaggtttgtcctcgaggaaacgccgatctcaagatgctttgactgtgcaatttctgattttgggaatgctgctgatggttggtggagtgaccctggtgcgcagaaacagatggttacttctgaatgttacatctgaggaccttgggaaaaccttttctgttggcacaggtaactgcacaaccaacattctggaggccaaatactggtgtccagattccatggaatacaactgccccaatcttagtccaagagaagagcctgatgacatagattgttggtgctatggagtggaaaatgtcagagtcgcttacggcaagtgtgattcagcgggtaggtcaagaaggtccagaagggccattgacttgcccacacatgaaaatcatggcttaaagacccggcaagaaaagtggatgaccggaagaatgggtgagagacaactgcagaaaattgaaagatggctggtaaggaaccccttttttgcggcaacagccttggccattgcctacctggtggggagcaacatgacgcaacgagttgtcatagccctgctagtcttggctgttggcccagcctattcggctcactgtataggaataaccgacagggatttcattgagggggtgcatgggggaacctgggtttcagccaccttggaacaggacaagtgtgtcactgtgatggcccctgacaagccttcactggacatatcactagaaacagttgccattgatggacctgctgaagcaaggaaggtgtgctacagtgcagtcttaaccaatgtgaagatcaatgacaagtgccccagcactggtgaagcccatttggaagaagaaaatgaaggagacaatgcttgtaagcgaacttactctgatagaggctggggaaatggttgtggcctgtttggaaaaggaagcattgtggcatgtgccaagtttacctgtgctaaatccatgagtctatttgaggttgatcagaccaaaattcagtatgtcattagggcacagctacatgttggagccaagcaggagaattggaacactgacatcaaaactctcaagtttgatgccctgtcaggctctcaggaagctgagttcactggatacgggaaggccacactggagtgccaggttcagaccgcagtggacttcagcaatagttacatcgcagagagagagaaagagagctggattgtggacaaacagtgggcccaagacttgaccctaccttggcagagtggaagtggcggcgtgtggagagagatgcatcatctcgtggaattcgagcctccacatgctgcaaccatcaaagtgttggctcttggaaaccaagaaggatccttgaagaccgctctcactggtgcaatgcgagttacaaaagacacaaataacagcaagctgtacaagctgcatggggggcacgtcgcgtgtagggtgaagttgtcagctctcacacttaagggaacatcctacaagatgtgtaccgacaaaatgtcctttgtcaagaatccaactgacactggacatggcactgcagtgatgcaagtgaaggtgccaaagggagcaccctgcagaataccagtaatggttgccgatgatctcacagcggcagtcaacaagggcatcttggtcacagtcaatccaatagcctccactaatgatgatgaagtgttgatcgaggtgaaccctccctttggggacagctatatcatagttggaactggggattcacgcctgacttaccagtggcacaaggaaggtagctcaatagggaagttgttcacccagaccatgaagggcgcagagcgcctggccgtcatgggggatgctgcctgggactttggctccgctggaggattcttcacatcagtcggaaaaggaatacacactgtgtttggttctgccttccaaggattgtttggtggcttgagctggataacaaaggtcattatgggggtagtcctcatatgggttggcattaacacaaggaacatgacaatgtccatgagcatgatcctagttggagtcatcatgatgttcctgtccctaggagttggggcggaccaaggatgtgcaataaactttggcaag

SEQ ID NO: 604 - RNA, 2091 nt, synthetic construct
  misc_feature 1..2091: note = derived and/or modified CDS sequence (wt) from YFV__JF912185__X-SS-prME-XX
  source 1..2091: mol_type = other RNA
atgagaggtttgtcctcgaggaaacgccgatcccaagatgttttaactgtgcaatttctgattctgggaatgctgctgatggttggtggagtgaccttggtacgtaaaaacagatggttacttctgaatgttacatctgaggaccttgggaaaaccttttctgttggcacaggtaactgcacaaccaatattctggaggccaaatattggtgtccagattccatggaatacaactgccctaatctcagtccaagagaagagcctgatgacatagactgctggtgttatggagtggaaaatgtcagagtcgcttatggcaagtgtgattcagctggtaggtcaagaaggtccagaagggccattgacttacccacacatgaaaatcatggcttaaagactcggcaagaaaagtggatgaccggaagaatgggcgagagacagctgcagaaaattgaaagatggctggtaaggaaccccttttttgcagcaacagccttggccattgcctacctggtggggagcaacatgacgcaacgagttgtcatagccctgctggtcctggctgttggcccagcctattcggctcactgtataggaataactgacagggatttcattgagggggtgcatggggggacctgggtttcagccaccttggaacaggacaagtgtgtcactgtgatggctcccgacaagccttcactggacatatcactagaaacagttgccattgatggacctgctgaagcaaggaaggtgtgctacagtgcagtcttaaccaatgtgaagatcaatgacaagtgccccagcactggtgaagcccacttggaagaagaaaatgaaggagacaatgcttgtaagcgaacttactctgacagaggttggggaaatggttgtggcctgtttggaaaaggaagcattgtggcatgtgccaagtttacctgtgctaaatccatgagtctatttgaggttgatcagaccaaaatccagtatgtcatcagggcacagctgcatgtcggagccaagcaggagaattggaatactgacatcaaaactctcaagtttgatgccctgtcaggatctcaggaagctgagttcactggatacgggagggccacactggagtgccaggtacagaccgcagtggacttcagcaacagttacatcgcagagatggagaaagagagctggattgtggataaacagtgggcccaagatctgaccctaccttggcagagtggaagtggcggcgtgtggagagagatgcatcatctcgtggaatttgaacctccacatgctgcaaccatcaaagtgttagcccttgggaaccaagaaggatccttgaagactgctctcactggtgcaatgcgagttacaaaagacacaaataacagcaagctgtacaagctgcatggggggcacgtcgcgtgtagggtgaagttgtcagctctcacacttaagggaacatcctacaagatgtgtaccgacaaaatgtcttttgtcaagaatccaactgacactggacatggcactgcggtgatgcaagtaaaggtgccaaagggggcaccctgcaggatcccagtgatggtcgccgatgatcttacagcggcagttaacaagggcattctggtcacagtcaatccaatagcctccactaatgacgatgaagtgttgatcgaggtgaaccctccttttggggacagctacatcatagttggaacaggggattcacgcttgacctaccagtggcacaaagaaggcagctcaatagggaagttgttcactcagaccatgaaaggcgcggagcgcctggccgtcatgggggatgctgcctgggacttcggctctgctgggggttttttcacatcagtcggaaaaggtatacacactgtgtttggttctgccttccaaggattgtttggtggcttgagctggataacaaaggtcatcatgggggtagtcctcatatgggttggcattaatacaaggaatatgacaatgtccatgagcatgatcctagttggagtcatcatgatgttcctgtccctaggagttggggcggaccaaggatgtgcaataaactttggcaag

SEQ ID NO: 605 - RNA, 2091 nt, synthetic construct
  misc_feature 1..2091: note = derived and/or modified CDS sequence (wt) from YFV__JF912186__X-SS-prME-XX
  source 1..2091: mol_type = other RNA
atgagaggtttgtcctcgaggaaacgccgatctcaagatgttttgaccgtgcaatttctgattctgggaatgctgctgatggttggtggagtgaccctggtgcgcagaagcagatggttacttctgaatgttacatctgaggaccttgggaaaaccttttctgttggcacaggtaactgcacaaccaacattctagaggccaaatactggtgtccagattccatggaatacaactgccccaatctcagtccaagagaagagcctgatgacatagattgttggtgttatggagtggaaaatgttagagtcgcttacggcaagtgtgattcagcgggtaggtcaagaaggtccagaagggccattgacttgcccacacatgaaaatcatggcttaaagacccggcaagaaaagtggatgaccggaagaatgggtgagagacaactgcagaaaattgaaagatggctggtaaggaaccccttttttgcggcaacagccttggccattgcctacctggtggggagcaacatgacacaacgagttgtcatagccctgctagtcttggctgttggcccagcctattcggctcactgtataggaataaccgacagggatttcattgagggggtgcatgggggaacctgggtttcagccaccttggaacaggacaagtgtgtcactgtgatggcccctgacaagccttcactggacatatcactagaaacagttgccattgatggacctgctgaagcaaggaaggtgtgttacagtgcagtcttaaccaatgtgaagatcaatgacaagtgccccagcactggtgaagcccatttggaggaagaaaatgaaggagataatgcttgtaagcgaacttactctgatagaggctggggaaatggttgtggcctgtttggaaaaggaagcattgtggcatgtgccaagtttacctgtgctaaatccatgagtctatttgaggtcgatcagactaaaattcagtatgtcattagggcacagctacatgttggagccaagcaggagaattggaacactgacatcaaaactctcaagtttgatgccctgtcaggctctcaggaagctgagttcactggatacgggaaggccacactggagtgccaggttcagaccgcagtggacttcagcaatagttacattgcagagatggagaaagagagctggattgtggacaaacagtgggcccaagacttgaccctaccttggcagagtggaagtggcggcgtgtggagagagatgcatcatctcgtggaattcgagcctccacatgctgcaaccatcaaagtgttagcccttggaaaccaagaaggatccttgaagaccgctctcactggtgcaatgcgagtcacaaaagacacaaacaacagcaagctgtacaagctgcatggggggcacgtcgcgtgtagggtgaagttgtcagctcttacacttaagggaacatcctacaagatgtgtaccgacaaaatgtcttttgtcaagaatccaactgacactggacatggcactgcagtgatgcaagtgaaggtgccaaagggagcaccttgcagaatcccagtaatggtcgccgatgatctcacagcggcagtcaacaagggtatcttggtcacggtcaatccaatagcctccaccaatgatgatgaagtgttgatcgaggtgaaccctccctttggggacagctacatcatagttggaactggggattcacgcttgacttaccagtggcacaaggaaggtagctcaatagggaagttgttcacccagaccatgaagggcgcagagcgcttggccgtcatgggggatgctgcctgggactttggctctgctggaggattcttcacatcagtcggaaaaggaatacacactgtgtttggctctgccttccaaggattgtttggtggcttgagctggataacaaaggtcattatgggggtagtcctcatatgggttggcattaacacaaggaatatgacaatgtccatgagcatgatcctagttggagtcatcatgatgttcctgtccctaggagttggggcggaccaaggatgtgcaataaactttggcaag

SEQ ID NO: 606 - RNA, 2091 nt, synthetic construct
  misc_feature 1..2091: note = derived and/or modified CDS sequence (wt) from YFV__JF912187__X-SS-prME-XX
  source 1..2091: mol_type = other RNA
atgagaggtttgtcctcgaggaaacgccgatcccaagatgttttaactgtgcaatttctgattctgggaatgctgctgatggttggtggagtgaccctggtacgcagaaacagatggttacttctgaatgttacatctgaggaccttgggaaaaccttctctgttggcacaggtaactgcacaaccaacattctggaggccaagtactggtgttcagattccatggaatacaactgccctaatctcagtccaagagaagagcctgatgacatagactgttggtgttatggagtggaaaacgtcagagttgcctatggcaagtgtgattcagcgggtaggtcaagaaggtccagaagggccattgacttacccacacatgaaaatcatggcttaaagacccggcaagaaaagtggatgactggaagaatgggcgagagacagctgcagaaaattgaaagatggctggtgaggaaccccttttttgcggcaacagccttggccattgcctacctggtggggagcaacatgacgcaacgagttgtcatagccctgctagttttggctgttggcccagcctattcggctcactgtataggaataaccgacagggatttcattgagggggtgcatgggggaacctgggtttcagccaccttggaacaggacaagtgtgtcactgtgatggcccccgacaagccttcactagacatatcactagaaacagttgccattgatggacctgctgaagcaaggaaggtgtgctacagtgcagtcttgaccaatgtgaagatcaatgacaagtgccccagcactggtgaagcccacttggaagaagaaaatgaaggagacaatgcttgcaagcgaacttactctgatagaggttggggaaatggttgtggcctgtttggaaaaggaagcattgtggcatgtgccaagtttacctgtgctaaatccatgagtctatttgaggttgatcagaccaaaattcagtatgtcattagggcacagctacatgtcggagccaagcaggagaattggaacactgacatcaagactctcaagtttgatgccctgtcaggctctcaggaagctgaattcactggatacgggagggccacactggagtgccaggtacagaccgcagtggacttcagcaacagttacattgcagagatggaaaaagagagctggattgtggataaacagtgggcccaagacctgaccctaccttggcagagtggaagtggcggcgtgtggagagagatgcatcatctcgtggaattcgagcctccacatgctgcaaccatcaaagtgttagcccttggaaaccaagagggatccttgaagactgccctcactggtgcaatgcgagtcacaaaagacacaaataacagcaagctgtataagctgcatggggggcacgtcgcgtgtagggtgaagttgtcagctctcacacttaagggaacatcctacaagatgtgtaccgacaaaatgtcttttgtcaagaatccaactgacactggacatggcactgcagtgatgcaagtgaaggtgccaaagggagcaccttgcaggatcccagtgatggtcgccgatgatctcacagcggcagtcaacaagggcatcttggtcacagtcaatccaatagcctccaccaatgatgatgaagtgttgatcgaggtgaatcctccctttggggatagttacatcatagttggaacaggggattcacgcctgacctaccagtggcacaaggaaggcagctcaatagggaagttgttcactcagaccatgaagggcgcagagcgcctggccgtcatgggggatgctgcctgggactttggttctgctggaggattcttcacatcagtcggaaaaggcatacacactgtgtttggctctgccttccaaggattgtttggtggcttgagctggataacaaaggtcatcatgggggtagtcctcatatgggttggcattaacacaaggaatatgacaatgtccatgagcatgattttagttggagtcatcatgatgttcctgtccctaggagttggggcggaccaaggatgtgcaataaactttggcaag

SEQ ID NO: 607 - RNA, 2091 nt, synthetic construct
  misc_feature 1..2091: note = derived and/or modified CDS sequence (wt) from YFV__JF912189__X-SS-prME-XX
  source 1..2091: mol_type = other RNA
atgagaggtttgtcctcgaggaaacgccgatcccaagatgttttaactgtgcaatttctgattctgggaatgctgctgatggttggtggagtgaccctggtacgcagaaacagatggttacttctgaatgttacatctgaggaccttgggaaaaccttctctgttggcacaggtaactgcacaaccaacattctggaggccaagtattggtgtccagattccatggaatacaactgccctaatctcagtccaagagaagagcctgatgacatagactgttggtgttatggagtggaaaatgtcagagtcgcctatggcaagtgtgattcagcgggtaggtcaagaaggtccagaagggccattgacttacccacacatgaaaatcatggcttaaagacccggcaagaaaagtggatgactggaagaatgggcgagagacagctgcagaaaattgaaagatggctggtgaggaaccccttttttgcggcaacagccttggccattgcctacctggtggggagcaacatgacgcaacgagttgtcatagccctgctagttttggctgttggcccagcctattcggctcactgcataggaataaccgacagggatttcattgagggggtgcatgggggaacctgggtttcagccaccttggaacaggacaagtgtgtcactgtgatggcccccgacaagccttcactagacatatcactagaaacagttgccattgatggacctgctgaagcaaggaaggtgtgctacagtgcagtcttgaccaatgtgaagatcaatgacaagtgccccagcactggtgaagcccacttggaagaagaaaatgaaggagacaatgcttgcaagcgaacttactctgatagaggttggggaaatggttgtggcctgtttggaaaaggaagcattgtggcatgtgccaagtttacctgtgctaaatccatgagtctatttgaggttgatcagaccaaaattcagtatgtcattagggcacagctacatgtcggagtcaagcaggagaattggaacactgacatcaagactctcaagtttgatgccctgtcaggctctcaggaagctgagttcactggatacgggagggccacactggagtgccaggtacagaccgcagtggacttcagcaacagttacattgcagagatggaaaaagagagctggattgtggataaacagtgggcccaagacctgaccctaccttggcagagtggaagtggcggcgtgtggagagagatgcatcatctcgtggaattcgaacctccacatgctgcaaccatcaaagtgttagcccttggaaaccaagagggatccttgaagactgccctcactggtgcaatgcgagtcacaaaagacacaaataacagcaagctgtataagctgcatggggggcacgtcgcgtgtagggtgaagttgtcagctctcacacttaagggaacatcctacaagatgtgtaccgacaaaatgtcttttgtcaagaatccaactgacactggacatggcactgcagtgatgcaagtgaaggtgccaaagggagcaccttgcaggatcccagtgatggtcgccgatgatctcacagcggcagtcaacaagggcatcttggtcacagtcaatccaatagcctccaccaatgatgatgaagtgttgatcgaggtgaatcctccctttggggatagttacatcatagttggaacaggggattcacgcctgacctaccagtggcacaaggaaggcagctcaatagggaagttgttcactcagaccatgaagggcgcagagcgcctggccgtcatgggggatgctgcctgggactttggttctgctggaggattcttcacatcagtcggaaaaggcatacacactgtgtttggctctgccttccaaggattgtttggtggcttgagctggataacaaaggtcatcatgggggtagttctcatatgggttggcattaacacaaggaatatgacaatgtccatgagcatgattttagttggagtcatcatgatgttcctgtccctaggagttggggcggaccaaggatgtgcaataaactttggcaag

SEQ ID NO: 608 - RNA, 2061 nt, synthetic construct
  misc_feature 1..2061: note = derived and/or modified CDS sequence (wt) from YFV__AH005112__X-SS-prME-XX
  source 1..2061: mol_type = other RNA
atgagagggttgtcctcaaggaaacgccgctcccacgatgttctgactgtgcaatttttgatcctgggaatgctgctgatggcgggtggagtaaccttggtgcggaaaaacagatggctactcctgaatgtgacatctgaggaccttgggaagaccttttctgtgggtacgggcaactgcacaacaaatattttggaagccaagtactggtgtccagattcaatggaatataactgtcctaacctcagtccaagagaggagccggatgacattgattgttggtgttacggagtggaaaatgtcagagttgcgtatggcaagtgtgactcagcaggcaggtcaagaaggtcaagaagagctattgacttgcccacgcatgaaaaccatggcctgaagactcggcaagaaaaatggatgactggaagaatgggggagaggcaactccaaaagattgagagatggcttgtgaggaatcccttctttgcagtaacagccttgaccatcgcctatctcgtgggcagcaacatgacgcaacgagtcgtgattgccctgctggttttggctgttggcccggcttactcagcccactgcattggaatcactgatagggatttcattgagggggtgcacggaggaacctgggtttcagccaccttagagcaagacaagtgtgtcactgtcatggcccctgacaagccttcactggacatctcactagagacagtggccattgacggacctgctgaggcgagaaaggtgtgttacaatgcagtcctcactcatgtgaagatcaatgacaagtgccctagcactggtgaggcccacctagctgaggaaaatgagggggataatgcgtgtaagcgcacttattcggatagaggctggggaaacggctgtggcctgttcgggaaaggaagcatcgtggcatgcgccaaatttacttgtgccaaaaccatgagcttgtttgaggttgaccagacaaagatccagtacgtcatcagagcacaactacatgttggggcaaagcaggaaaattggaacaccgacatcaaaactctcaagtttgatgcattgtcaggctctcaggaagccgagttcactgggtatggaaaagctactctggaatgtcaggtgcaaactgcagtagactttggcaacagctacatcgctgagatggaaaaggagagctggatagtggacaggcaatgggctcaggatttaaccttgccatggcagagcggcagtggtggggtgtggagggaaatgcaccatcttgttgaatttgaacctcctcatgccgcaactattagagtgctggccctaggaaaccaggaaggctctttaaaaacagcccttacaggtgcaatgagggttacaaaggacacgaatgacaacaatctgtacaaactacatggcggacatgtctcctgcagagtaaaattgtcagctttaacactcaaggggacatcttacaagatgtgcactgataagatgtcttttgttaagaacccgactgacactggccatggcactgttgtgatgcaggttaaagtgccaaaaggagctccctgcaagatcccagtgatagtagctgatgatcttacagcggcaatcaataaaggcattttggttacagttaaccccatcgcctcaaccaatgatgatgaagtgttgatcgaagtgaatccaccctttggagatagttacattatagttgggacaggagattcacgtctcacctatcaatggcacaaagagggaagttcaataggaaagctgttcacccagactatgagaggccaggagcgcctggctgtcatgggagacactgcctgggattttagctctgctggagggttcttcacttcgattgggaaaggaattcacacggtgtttggctctgcctttcagggactttttggtggcttgagctggataacgaaggtcatcatgggcgcggtccttatatgggtcggcatcaacacaaggaacatgacaatgtccatgagcatgatcctagtaggagtgatcatgatgttcttgtctctgggagttggggcg

SEQ ID NO: 609 - RNA, 2091 nt, synthetic construct
  misc_feature 1..2091: note = derived and/or modified CDS sequence (wt) from YFV__FJ654700__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttagtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtatgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcactgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgtcactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 610 - RNA, 2091 nt, synthetic construct
  misc_feature 1..2091: note = derived and/or modified CDS sequence (wt) from YFV__KM388817__X-SS-prME-XX
  source 1..2091: mol_type = other RNA
atgagaggtttgtcctcgaggaaacgccgatcccaagatgttttaactgtacaatttttgattctgggaatgctgctgatggctggtggagtgaccctggtacgcagaaacagatggttacttctgaatgttacatctgaggaccttgggaaaaccttctctgttggcacaggcaactgcacaaccaacattctggaggccaaatattggtgtccagattccatggaatacaactgccccaatctcagtccaagagaagagcctgatgacatagactgctggtgctatggagtggaaaatgtcagagtcgcttatggcaagtgtgattcagcaggtaggtcaagaaggtccagaagggccattgacttacccacacatgaaaatcatggcttaaagacccggcaagaaaagtggatgactggaagaatgggcgagagacagctgcagaaaattgaaagatggctggtgaggaaccccttctttgcggcaacagccttgaccattgcctacctggtggggagcaacatgacgcaacgagttgtcattgccctgctagtcttggctgttggcccagcctattcggctcactgtataggaataaccgacagggatttcattgagggggtgcatgggggaacctgggtttcagccaccttggaacaggacaagtgtgtcactgtgatggcccccgacaagccttcactagacatatcactagaaacagttgccattgatggacctgctgaggcaaggaaggtgtgctacagtgcagtcttaaccaatgtgaagatcaatgataagtgccccagcactggtgaagcccacttggaagaagaaaatgaaggagacaatgcttgcaagcgaacttactccgatagaggttggggaaatggttgtggcttgtttggaaaaggaagcattgtggcatgtgccaagtttacctgtgccaaatccatgagtctatttgaggttgatcagaccaaaattcagtatgtcattagggcacagctacatgtcggagccaagcaggagaattggaacactgacatcaaaactctcaagtttgatgccctgtcaggctctcaggaagctgagttcactggatacgggagggccacactggagtgccaggtacagaccgcagtggacttcagtaacagttacattgcagagatggagaaagagagctggattgtggataaacagtgggcccaagacctgaccctaccttggcagagtggaagtggcggcgtgtggagagagatgcatcatctcgtggaatttgagcctccacatgctgcaaccatcaaagtgttagcccttggaaaccaagaaggatccttgaagactgccctcactggtgcaatgcgagtcacaaaagacacaaataacagcaagctgtataagctgcatggggggcacgtcgcgtgtagggtgaagttgtcagctctcacactcaagggaacatcctacaagatgtgtaccgacaaaatgtcttttgtcaagaacccaactgatactggacatggcactgcagtgatgcaagtgaaggtgccaaaaggagcaccctgcaggattccagtaatggttgccgatgatctcacagcggcagtcaacaagggcatcttggtcacagtcaatccaatagcctccaccaatgatgatgaagtgttgatcgaggtgaatcctccctttggggatagttacatcatagttgggacaggggattcacgcctgacttaccagtggcacaaggaaggcagctcaatagggaagttgtttactcagaccatgaagggcgcagagcgcctggccgtcatgggggatgctgcctgggactttggttctgctggaggattcttcacatcagtcggaaaaggtatacacactgtgtttggctctgccttccaaggactgtttggtggcttgagctggataacaaaggtcatcatgggggtagtcctcatatgggttggcattaacacaaggaatatgacaatgtccatgagcatgatcctagttggagtcatcatgatgttcctgtccctaggagttggggcggaccaaggatgtgcaataaactttggcaag

SEQ ID NO: 611 - RNA, 2091 nt, synthetic construct
  misc_feature 1..2091: note = derived and/or modified CDS sequence (wt) from YFV__HM582851__X-SS-prME-XX
  source 1..2091: mol_type = other RNA
atgagaggtttgtcctcgaggaaacgccgatcccaagatgttttaactgtgcaatttctgattctggggatgctgctgatggttggtggggtgaccctggtacgcagaaacagatggttacttctgaatgttacatctgaggaccttgggaaaaccttctctgttggcacaggtaactgcacaaccaacattctggaggccaaatactggtgtccagattccatggaatacaactgccctaacctcagtccaagagaagagcctgatgacatagactgctggtgttatggagtggaaaatgtcagagtcgcttatggcaagtgtgattcagcgggcaggtcaagaaggtccagaagggccattgacttacccacacatgaaaatcatggcttaaagacccggcaagaaaagtggatgactggaagaatgggcgagagacagctgcagaaaattgaaagatggctggtgaggaaccccttttttgcggcaacagccttggctattgcctacctggtggggagcaacatgacgcaacgagttgtcatagccttgctagtcttggctgttggcccagcctattcggctcactgtataggaataaccgacagggacttcattgagggggtgcatgggggaacctgggtttcagccaccttggaacaggacaagtgtgtcactgtgatggcccccgacaagccttcactagacatatcactagaaacagttgccattgatggacctgctgaagcaaggaaggtgtgctacagtgcagtcttaaccaatgtgaagatcaatgacaagtgccccagcactggtgaagcccacttggaagaagaaaatgaaggagacaatgcttgcaagcgaacttactctgatagaggttggggaaatggttgtggcctgtttggaaaaggaagcattgtggcatgtgccaagtttacttgtgctaaatccatgagtctatttgaggttgatcagaccaaaatccagtatgtcattagggcacagctacatgtcggagccaagcaggagaactggaacactgacatcaagactctcaagtttgatgccctgtcaggctctcaggaagctgagttcactggatacgggagagccacactggagtgccaggtacagaccgcagtggactttagcaacagttacattgcagagatggaaaaagagagttggattgtggataaacagtgggcccaggacctgaccctaccttggcagagtggaagtggcggcgtgtggagagagatgcatcatctcgtggaatttgagcctccacatgctgcaaccatcaaagtgttagcccttggaaaccaagaaggatccttgaagactgccctcactggtgcaatgcgagtcacaaaagacacaaataacagcaagctgtataagctgcatggggggcacgtcgcgtgtagggtgaagttgtcagctcttacacttaagggaacatcctacaagatgtgtaccgacaaaatgtcttttgtcaagaatccaactgacactggacatggcactgcagtgatgcaagtgaaggtgccaaagggagcaccctgtaggatcccagtgatggttgctgatgatctcacagcggcagtcaacaagggcatcctggtcacagtcaatccaatagcctccaccaatgatgatgaagtgttgatcgaggtgaatcctccttttggggacagttacatcatagttggaacaggggattcacgcctgacttaccagtggcacaaggaaggcagctcaatagggaagttgttcactcagaccatgaagggcgcagagcgcctggccgtcatgggggatgctgcctgggactttggctctgctggaggattcttcacatcagtcggaaaaggcatacacactgtgtttggctctgccttccaaggattgtttggtggcttgagctggataacaaaggtcattatgggggtggtcctcatatgggttggcattaacacaaggaatatgacaatgtccatgagcatgatcctagttggagtcatcatgatgttcctgtccctaggagttggggcggaccaaggatgtgcaataaactttggcaag

SEQ ID NO: 612 - RNA, 2091 nt, synthetic construct
  misc_feature 1..2091: note = derived and/or modified CDS sequence (wt) from YFV__JN620362__X-SS-prME-XX
  source 1..2091: mol_type = other RNA
atgagagggttgtcatctaggaagcgtcgctctaatgagatgaccatgatgccacttctaatcttgagcatggtgatcttggctggaggggtgacactcgtccggaaaaaccgatggctactcttgaatgtcacagctgaggacttgggaaagacgttctcagtgggaaccgggaactgcaccaccaacatccttgaggcaaagtattggtgtcccgactcaatggaatacaattgtcccaatcttagccccagagaggagcctgatgacattgactgttggtgttatggagtggaaaatgtccgagtagcctatggaaggtgtgatgcagtgggaaggtcaaagagatctaggagagcaattgatctgcccacacatgaaaaccacggactgaaaactcggcaggaaaaatggatgacaggcagaatgggtgagcggcaactccaaaagattgagcggtggctggtgaggaatccgttcttcgccataacagccttggccattgcttatttggtgggcaataatatgacacaacgtgtcgtcatagctctgctggttctggcagttggcccagcctattctgcacattgcattgggataactgacagagacttcattgagggtgtccatgggggcacctgggtgtcagcaaccctggagcaggataagtgcgtgactgtcatggcgcctgataaaccatcactggacatctcactccaaacagtggcaatagatgggccagctgaagcgagaaaggtttgctacagcgcggttctcacccatgtaaaaatcaatgataaatgcccgagcactggtgaggctcaccttgcagaggaaaatgatggtgacaacgcgtgcaaacgaacatactcagatagaggctggggcaatggttgtgggctctttggaaaggggagcattgtggcatgtgctaagttcacgtgtgccaaatccatgagcctttttgaagtggaccagaccaaaatccagtatgtcatcagagcccagcttcatgtaggtgccaagcaggaaaactggaacacagacataaagacattgaaatttgatgccttatctggctctcaagaggccgaatttactggctatgggaaagcaacactagagtgtcaggtccagactgcggtggactttggaaacagctacattgcagagatggagaaagacagctggattgttgaccgccagtgggcacaagacttgacactaccatggcagagtgggagtggtggaatatggagggaaatgcatcatctagttgagtttgagcctcctcatgccgccacaatcagagtgttggccctgggaaaccaagaggggtctttgaaaacagcccttacaggagccatgcgggtcactaaagatgaaaatgacaacaacttgtacaagctgcatggtggtcatgtttcttgtagggtgaaactctcagctttaactctcaagggaacatcctacaaaatgtgcacagataaaatgtcatttgtgaaaaatccaacggacacaggtcatggcactgttgtcatgcaggtgaaggtccccaaaggagctccatgcaagatccccgtgattgtggccgatgatctaacagctgcagtgaacaagggtatattggtcactgtcaaccccatagcatccacaaatgacgatgaagttctaattgaagtcaatcccccttttggagacagctacattattgttgggactggagactcaagactgacttatcagtggcataaagaaggaagctcaatagggaaattgttcacacagacaatgaagggagctgaacgtcttgcagtgatgggtgacgccgcctgggactttagctctgcaggtggcttcttcacgtcagtgggaaaaggaattcatactgtgtttggctcagctttccaggggttgtttggtggcctgagctggattacaaaggtcatcatgggagctgttcttatctgggttggaattaacacacgtaacatgactatgtccatgtctatgattctggtaggagtgatcatgatgtttctttccctgggtgttggggcagaccaaggatgtgctgtcaactttgggaag

SEQ ID NO: 613 - RNA, 2091 nt, synthetic construct
  misc_feature 1..2091: note = derived and/or modified CDS sequence (wt) from YFV__JN811142__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggactaccgacattaagactctcaggtttgatgccctgtcaggctcccaggaagtcgagttcattgggtatggaaaagccacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 614 - RNA, 2091 nt, synthetic construct
  misc_feature 1..2091: note = derived and/or modified CDS sequence (wt) from YFV__DQ100292__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacagctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggcgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgccaaaaggagccccctgcaggattccagtgatagtagctgatgatcttacagcggcagtcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtactcatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 615 - RNA, 2091 nt, synthetic construct
  misc_feature 1..2091: note = derived and/or modified CDS sequence (wt) from YFV__DQ118157__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 616 - RNA, 2091 nt, synthetic construct
  misc_feature 1..2091: note = derived and/or modified CDS sequence (wt) from YFV__DQ235229__X-SS-prME-XX
  source 1..2091: mol_type = other RNA
atgatagggctgtcatctaggaaacgccgctctaatgagatggccatgatgccacttctaatcttgagcatggtgattttggctggaggggtgacactcgtccggaaaaatcgatggttgcttttgaatgtcacagctgaggacttgggaaagacgttctcattgggaaccgggaactgcaccaccaacatccttgaggcaaagtattggtgtcccgactcaatggaatacaactgtcccaatctcagtcccagagaggagcctgacgacattgactgttggtgttatggagtggaaaatgtcagagtggcctatggaaggtgtgatgcagtggggaggtcaaagcggtctaggagggcaattgatctgcccacgcatgaaaatcacggactgaaaactcggcaggagaaatggatggcaggcagaatgggtgagcggcaactccaaaagattgagcggtggctggtgagaaatccgtttttcgccataacagccttggccattgcttatttagtgggtaataacatgacacaacgtgtcgtcatagctctgctagtcttagcagttggtccagcctattctgcacattgtattgggataactgacagagacttcattgagggtgtccatgggggcacgtgggtgtcagcaaccctagagcagggcaagtgcgtaactgtcatggctcctgataaaccatcattggatatctcgctccaaacagtggcaatagatgggcctgctgaagcgagaaaggtttgctacagcgcggttctcacccatgtaaaaatcaatgacaagtgcccaagcactggtgaggctcacctcgcagaggaaaatgatggtgacaatgcttgcaaacgaacatactcagatagaggctggggtaatggttgtgggctctttggaaaggggagtattgtggcatgtgccaaatttacgtgtgccaaatccatgagcctttttgaagtggaccagaccaaaatccagtacgttatcagggctcagcttcatgtgggtgctaagcaggagaactggaacacagatataaagacactgaaatttgatgccctatctggctctcaagaagccgaatttactggttatgggaaagcaacactggagtgtcaggtccagactgcagttgactttgggaacagttacattgcagagatggagaaagacagctggattgttgaccgccagtgggcacaagacttgacactaccatggcagagcgggagtggtggaatatggagggaaatgcatcatcttgttgagtttgagcctcctcatgccgccacaatcagagtgctagccttgggaaaccaagaggggtctctgaaaacagctctcacaggagctatgcgggtcactaaagatgaaaatgacaacaacttgtacaagctgcatggtggtcatgtctcttgtagggtgaaactttcagctctaactcttaagggaacatcctacaagatgtgcacagataaaatgtcatttgtgaaaaacccaacggacacaggtcatggcacggttgtcatgcaggtgaaggtccccaaaggagccccatgcaagattcccgtgattgtggctgatgacctaacggctgcagtgaacaagggcatactggtcactgtcaaccccatagcatccacaaatgatgatgaagtcctaattgaagtcaatcccccttttggagacagctacatcattgttgggactggagactcaagactgacttatcagtggcataaggaaggaagttcaattgggaaactgttcacacagacaatgaagggagctgaacgtcttgcagtgatgggtgatgccgcctgggactttagctctgcaggtggtttcttcacgtcagtggggaaaggaattcacactgtgtttggctcagctttccaggggttgtttggtggtctgagctggattacgaaagtcatcatgggagccgttctcatctgggtaggaattaacacacgtaacatgaccatgtccatgtctatgattctggtaggtgtgatcatgatgttcctctccctgggtgttggggcagaccaaggatgtgctgtcaactttgggaag

SEQ ID NO: 617 - RNA, 2088 nt, synthetic construct
  misc_feature 1..2088: note = derived and/or modified CDS sequence (wt) from YFV__DQ322633__X-SS-prME-XX
  source 1..2088: mol_type = other RNA
atgggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 618 - RNA, 2067 nt, synthetic construct
  misc_feature 1..2067: note = derived and/or modified CDS sequence (wt) from YFV__DQ322634__X-SS-prME-XX
  source 1..2067: mol_type = other RNA
atgcgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 619 - RNA, 2061 nt, synthetic construct
  misc_feature 1..2061: note = derived and/or modified CDS sequence (wt) from YFV__DQ322642__X-SS-prME-XX
  source 1..2061: mol_type = other RNA
atgcgcggcctgtcctctcgcaagaggcgctcccacgatgtgctcaccgtccaattcctcattctgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggcggtacttatatgggttggcatcaacacaagaaacatgacaatgtccatgagcatgatcttggtaggagtgatcatgatgtttttgtctctaggagttggggcg

SEQ ID NO: 620 - RNA, 2091 nt, synthetic construct
  misc_feature 1..2091: note = derived and/or modified CDS sequence (wt) from YFV__GQ379162__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccgagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacagctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggcgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggaataccagcattaagactctcaagtttgatgccctgtcaggctcccaggaagtcgagttcattgggtatggaaaagctacactggaatgccaggtgcaaactgcggtggactttggtaacagttacatagctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgccaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacgtcgcctgggatttcagctccgctggagggttcttcacttcggttgggaaaggaattcatacggtgtttggctctgcctttcaggggctatttggcggcttgaactggataacaaaggtcatcatgggggcggtactcatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 621 - RNA, 2085 nt, synthetic construct
  misc_feature 1..2085: note = derived and/or modified CDS sequence (wt) from YFV__DQ859065__X-SS-prME-XX
  source 1..2085: mol_type = other RNA
atgctgaaaggagtatctgggcggaaaaagcgacgatcagtggaagcaacaggctttgtcagtacgcttctatttggcatcgtgctcacggcctctgtctcacgccacgcccatcacacattgttgaatgtaactaaagaagacacaaatcaaattctaacgctgcgcaatggcaactgcaccgtggtctcaatggatgtaggctcttggtgtgacgacaacgttgaatatgattgtgtcactctgcaagacaatgaagaacctgacgacgtggactgttggtgctacaaggtgaatggggttcgtgtgacatacggaaaatgccgtgagggaaacacccccagacgatctaaaagagcagtagtcattacagctcatttggatcagggcttgacaacaaagaaggaaacatggctgggtagcagtcattttgagacccagattcagaaaattgaaaaatggattattcggaacccaacatatgccattgcagctattatcatggcttggtacattggcaactccactaaacaacgtgtggttttgttactcctaactttagctttggggcctgcttatgccactcattgtgttggcatagcaaagagggacttcgtgcaaggggtccagggcacaacatgggttaacgtggtaatggagcaaggtgcatgtgttacgatagtaacagagggaaaaccaagtgtggatgtttggatggaaggaatcacattctcctcaccaaccatggtccggaggatcagtcacacagccactatcagtgacacgaaaatctcatcagcctgcccctctacaggggaagctaagttggatgaggagcatgacaaaacctttgagtgcaaaagaacgtactcagatagaggctggggcaatggttgtggattgtttggtaaaggaagcattgtggcttgtgccaagttcacttctaccggacacatggatgtctatgagatggacatgacaaaggttgaatacacgattaaaacccaagttcattcaggggcaaaaagtgatgatacaacaggagtgaaagaaatcaagtttactccagtgtcaggcactcaaactgtggaattccctggatatgggaatttgggactagagtgtatcgttcagtcggacattgacttcacaactcattatttggttgttctgggaactgatgcttggctcgttcacaaagcttgggtcgaagatgtaacattgccatggaaacatgaaggggcagccagctggagagacaagcaatacctggttgagtttggtgaaccacatgccgccacgatcaaagtgttggtccttgggtcccaagagggcgccctgaggactgctctggctggggccatgatggtgactcatgacagttcagcaaagacattcaaactccatggtggtcatgtaacttgcaaagcgaaacttaatgatctggtcattaaagggactacctacacaaactgtagaggtggtttgtctttcgtgaagacaccaactgatactggacatggaactgtggtgatgcaagtcaaagtttctcgaaatgctccatgccgcctcactgtgatagcagctgatgatgcatctggtcatgtcaaccgtggtaccctggtgacgagcaacccaatagccaattcaaacaatgatgaggttctagttgaggtgaatcccccatatggatctagttacctcatagttggaactggcgatgataagcttgtttatcaatggaagaaatccggcagctccatcgggaaactgttctcagagacggtgaagggagcgcaaagaatggcaattgttggcagctcgtcgtgggatttttcatcagcagggggttttttctcatcagtcgggaaggccctgcacactgtgttcggcaccgctttccaggggatttttggagggcttagttggatcacgagggtcctgattggtgtcttgctaatctggcttggactaaattcaaggaatggaatggccacaacagtcatgatgattactggttttgtgatcctcttcctgtcactaggagtgggagctgagatcggatgctcagttaactggggccaa

SEQ ID NO: 622 - RNA, 2091 nt, synthetic construct
  misc_feature 1..2091: note = derived and/or modified CDS sequence (wt) from YFV__KU921608__X-SS-prME-XX
  source 1..2091: mol_type = other RNA
atgagaggactggcttccaggaaacgtagatccaatgaaatggccttgtttccactcttgttactgggtttgttggctctatcaggaggagtgaccctcgtcagaaagaacagatggttgctcctgaatgtaactgctgaagacctggggaaaacgttttcagtgggaactgggaattgcaccacgaatattctggaagcaaaatactggtgccccgactcaatggaatacaattgccccaatctcagtccaagagaagagccagatgacatagattgctggtgttatggagtggaaaatgtcagagtggcctatggaagatgtgatgcggtagggcgatcaaaacgctccaggagagcgattgatctacccacacatgagaaccatggactaaagactcggcaggagaagtggatgacaggcagaatgggtgagaggcagctccagaagattgaaagatggctggttaggaatccattttttgcggtcacagcattggcaatagcctatctggtgggtaacaacacgacacaacgagtggtcatagcactactggttctagcggttggtccagcgtactctgcccattgcatagggataaccgacagagatttcattgaaggtgtccatgggggcacttgggtgtcagccactctggagcaggacaaatgcgtgactgtaatggcccctgacaaaccttctctggacatctcactacaaacagtggcaatcgatggaccggctgaagcgaggaaggtttgctacagtgcagtcctaacccatgtgaagatcaatgacaaatgcccgagcactggtgaggcccaccttgcagaggaaaatgatggtgacaatgcttgtaaacggacatattctgacagaggctggggcaatggctgtggtctttttgggaaaggaagcatcgtggcttgtgccaagtttacatgtgccaaatctatgagtctctttgaggtggatcagaccaaaatccaatatgtcatcagggcccagctccatgtgggtgccaaacaggaaaactggaacacagacataaaaacgctgaaatttgatgctctttctggctcacaggaggctgaattcactggttatggaaaggcaacactagagtgtcaggtccagactgccgtggactttgggaacagctacatcgcagagatggaaaaagatagctggatcgttgaccgccaatgggcacaggacttgacactgccatggcagagtgggagtggtggcatatggagagaaatgcaccaccttgttgagtttgagcccccacatgctgccacaattagggtgctggccttgggcaatcaagaaggctccttgaagaccgctctcacaggcgctatgcgcgtcaccaaggatgagaatgacaacaacttgtacaaactgcacggtggtcacgtctcctgtagagtgaaactgtcagccctcactctcaaaggaacatcctacaagatgtgcacagacaaaatgtcatttgtcaagaatccaacggatacagggcatggcacagttgtcatgcaagtaaaggtccccaaaggggccccatgcaagattcctgtgattgtggcagatgacctaacggcagcagtgaacaaaggcatcttggtcactgtcaatcctattgcatccacaaatgatgatgaagttctgattgaggtcaatcccccttttggggatagctacatcatagttgggactggagactcacgactgacctatcagtggcacaaagaagggagttcaataggaaaattgttcacacagacaatgaaaggagctgaacgtcttgcagtgatgggtgatgctgcttgggattttagttctgctggggggttcttcacatctgtgggaaaaggaatccataccgtgtttggctcggccttccaggggctgtttggtggcttgagttggatcacgaaagtcatcatgggagccgtgctcatctgggtgggaataaacacccgcaacatgaccatgtccatgtccatgatcttggtaggtgtgatcatgatgtttctttcactaggagttggggctgaccaaggatgtgctgttaactttgggaaa

SEQ ID NO: 623 - RNA, 2091 nt, synthetic construct
  misc_feature 1..2091: note = derived and/or modified CDS sequence (wt) from YFV__KX010994__X-SS-prME-XX
  source 1..2091: mol_type = other RNA
atgagagggctgtcttccaggaaacgtagatccaatgaaatggccatgtttccactcctgttactgggtttgttggctctatcaggaggagtgaccctcgtcagaaagaacagatggttgctcttgaatgtaactgctgaagacctggggaaaacgttttcagtgggaactgggaattgcaccacgaatattctggaagcaaaatactggtgccccgactcaatggagtacaattgtcccaatctcagtccaagagaagagccagatgacatagattgctggtgttatggagtggaaaatgtcagagtggcctatggaagatgtgatgcggtagggcgatcaaaacgctccaggagagcgattgatctacccacacatgagaaccatggactaaagactcggcaggagaagtggatgacaggcagaatgggtgagaggcagctccagaagattgaaagatggctggttaggaatccattttttgcggtcacagcattggcaatagcctatctggtgggtaacaacacgacacaacgagtggtcatagcactactggttctagcggttggtccagcgtactctgcccattgcatagggataaccgacagagatttcattgaaggtgtccatgggggcacttgggtgtcagccactctggagcaggacaaatgcgtgactgtaatggcccctgacaaaccttctctggacatctcactacaaacagtggcaatcgatggaccggctgaagcgaggaaggtttgctacagtgcagtcctaacccatgtgaagatcaatgacaaatgcccgagcactggtgaggcccaccttgcagaggaaaatgatggtgacaatgcttgtaaacggacatattctgacagaggctggggcaatggctgtggtctttttgggaaaggaagcatcgtggcttgtgccaagtttacatgtgccaaatctatgagtctctttgaggtggatcagaccaaaattcaatatgtcatcagggctcagctccatgtgggtgccaaacaggaaaactggaacacagacataaaaacgctgaaatttgatgctctttctggctcacaggaggctgaattcactggttatggaaaagcaacactggagtgtcaggtccagactgccgtggactttgggaacagctacatcgcagagatggaaaaagatagctggatcgttgaccgccaatgggcacaggacttgacactgccatggcagagtgggagtggtggcatatggagagaaatgcaccaccttgttgagtttgagcccccacatgctgccacaattagggtgctggccttgggcaatcaagaaggctccttgaagaccgctctcacaggcgctatgcgcgtcaccaaggatgagaatgacaacaacttgtacaaactgcacggtggtcacgtctcctgtagagtgaaactgtcagctctcactctcaaaggaacatcctacaagatgtgtacagacaagatgtcatttgtcaagaatccaacggatacagggcatggcacagttgtcatgcaagtaaaggtccccaaaggggccccatgcaagattcccgtgattgtggcagatgacctaacggctgcggtgaacaaaggcatcttggtcactgtcaatcctattgcatccacaaatgatgatgaagttctgattgaggtcaatcccccttttggggatagctacatcatagttgggactggagattcacgactgacctatcagtggcacaaagaagggagttcaataggaaaattgtttacacagacaatgaaaggagctgaacgtcttgcagtgatgggtgatgctgcttgggattttagttctgctggggggttcttcacatctgtgggaaaaggaatccataccgtgtttggctcggccttccaggggctgtttggtggcttgagttggatcacgaaagtcatcatgggagccgtgctcatctgggtgggaataaacacccgcaacatgaccatgtccatgtccatgatcttggtaggtgtgatcatgatgtttctttcactaggagttggggctgaccaaggatgtgctgttaactttgggaaa

SEQ ID NO: 624 - RNA, 2091 nt, synthetic construct
  misc_feature 1..2091: note = derived and/or modified CDS sequence (wt) from YFV__KX027336__X-SS-prME-XX
  source 1..2091: mol_type = other RNA
atgagagggctggcttccaggaaacgtagatccaatgaaatggccatggtaccactcctgttactgggtttgttggctctatcaggaggagtgaccctcgtcagaaagaacagatggttgctcctgaatgtaactgctgaagacctggggaaaacgttttcagtgggaactgggaattgcaccacgaatattctggaagcaaaatactggtgccccgactcaatggaatacaattgccccaatctcagtccaagagaagagccagatgacatagattgctggtgttatggagtggaaaatgtcagagtggcctatggaagatgtgatgcggtagggcgatcaaaacgctccaggagagcgattgatctacccacacatgagaaccatggactaaagactcggcaggagaagtggatgacaggcagaatgggtgagaggcagctccagaagattgaaagatggctggttaggaatccattttttgcggtcacagcattggcaatagcctatctggtgggtaacaacacgacacaacgagtggtcatagcactactggttctagcggttggtccagcgtactctgcccattgcatagggataaccgacagagatttcattgaaggtgtccatgggggcacttgggtgtcagccactctggagcaggacaaatgcgtgactgtaatggcccctgacaaaccttctctggacatctcactacaaacagtggcaatcgatggaccggctgaagcgaggaaggtttgctacagtgcagtcctaacccatgtgaagatcaatgacaaatgcccgagcactggtgaggcccaccttgcagaggaaaatgatggtgacaatgcttgtaaacggacatattctgacagaggctggggcaatggctgtggtctttttgggaaaggaagcatcgtggcttgtgccaagtttacatgtgccaaatctatgagtctctttgaggtggatcagaccaaaatccaatatgtcatcagggcccagctccatgtgggtgctaaacaggaaaactggaacacagacataaaaacgctgaaatttgatgctctttctggctcacaggaggctgaattcactggttatggaaaggcaacactagagtgtcaggtccagactgccgtggactttgggaacagctacatcgcagagatggaaaaagatagctggatcgttgaccgccaatgggcacaggacttgacactgccatggcagagtgggagtggtggcatatggagagaaatgcaccaccttgttgagtttgagcccccacatgctgccacaattagggtgctggccttgggcaatcaagaaggctccttgaagaccgctctcacaggcgctatgcgcgtcaccaaggatgagaatgacaacaacttgtacaaactgcacggtggtcacgtctcctgtagagtgaaactgtcagccctcactctcaaaggaacatcctacaagatgtgcacagataaaatgtcatttgtcaagaatccaacggatacagggcatggcacagttgtcatgcaagtaaaggtccccaaaggggccccatgcaagattcccgtgattgtggcagatgacctaacggcagcagtgaacaaaggcatcttggtcactgtcaatcctattgcatccacaaatgatgatgaagttctgattgaggtcaatcccccttttggggatagctacatcatagttgggactggagactcacgactgacctatcagtggcacaaagaagggagttcaataggaaaattgttcacacagacaatgaaaggagctgaacgtcttgcagtgatgggtgatgctgcttgggattttagttctgctggggggttcttcacatctgtgggaaaaggaatccataccgtgtttggctcggccttccaggggctgtttggtggcttgagttggatcacgaaagtcatcatgggagccgtgctcatctgggtgggaataaacacccgcaacatgaccatgtccatgtccatgatcttggtaggtgtgatcatgatgtttctttcactaggagttggggctgaccaaggatgtgctgttaactttgggaaa

SEQ ID NO: 625 - RNA, 2091 nt, synthetic construct
  misc_feature 1..2091: note = derived and/or modified CDS sequence (wt) from YFV__JX898868__X-SS-prME-XX
  source 1..2091: mol_type = other RNA
atgagaggattgtcctcaaggaaacgccgttcccatgacgctctggctgtgcaattcctaattctgggaatgctattgatggcgggtggagtgaccttggtgcggaaaaacagatggttgctcctaaatgtgacatctgaagacctcgggaaaacattctccgtgggtacaggcaactgcactacaaacatcttggaagccaagtactggtgcccagattcaatggaatacaactgtcctaatctcagtccaagagaggagccagatgatattgattgctggtgctatggggtggaaaacgtcagagtcgcatatggcaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggcttgtgaggaaccccttttttgcagtgacggccttgaccattgcctaccttgtgggaagcaacatgatgcaacgagtcgtgattgccctactggtcttggctgtcggtccggcctactcagctcactgcattggaattaccgacagggatttcattgagggggtgcatggaggaacctgggtttcagccaccctagagcaagacaagtgtgtcactgttatggcccctgacaagccttcattggacatttcactagagacagtagccattgatggacctgctgaggcgaggaaagtgtgttacaatgcagtcctcacccatgtgaagattaatgacaagtgccccagcaccggagaggctcacctagctgaagagaacgagggggataatgcgtgcaagcgtacttattctgatagaggctggggtaatggttgtggcctgtttgggaaagggagcattgtggcatgcgccaaattcacttgtgccaaatccatgagcttgtttgaggttgatcagaccaaaatccagtatgtcatcagagcacaattgcatgttggggccaagcaggaaaattggaataccgacattaaaactctcaagtttgatgccctatcaggctcccaggaggccgagttcactgggtatggaaaagctacactggaatgccaggtgcaaactgcggtggactttggtaacagttacatcgctgagatggaaaaagagagctggatagtggacagacagtgggctcaggacttgaccctgccatggcagagcggaagtggcggggtgtggagagagatgcatcatcttgttgagtttgaacctccgcatgccgcaactatcagagtgctggccctgggaaaccaggaaggctccttgaaaacagctcttaccggtgcaatgagggttacaaaggacacaaatgacaataacctttacaaactacatggtggacatgtctcttgcagagtgaaattgtcagctttgacactcaaggggacatcttacaaaatgtgcactgacaaaatgtcctttgtcaagaacccaactgacactggtcatggcactgttgtgatgcaggtgaaagtgccaaaaggagccccctgcaagatcccagtgatagtagctgatgaccttacagcggcaatcaataaaggcattctggtcacagtcaatcccatagcttcaactaatgatgatgaagtgctgattgaggtgaacccaccatttggagatagctacatcatcgttgggacaggagattcacgtctcacctaccagtggcacaaagaggggagttcaataggaaaactgttcactcagaccatgaaaggtgcggaacgcctggccgtcatgggagacgccgcctgggattttagctcagctggaggtttcttcacttcggttgggaaaggaattcacacggtgtttggctctgcctttcaggggctatttggtggcttgagctggataacgaaggtcatcatgggggcggtactcatatgggttggcatcaacacaagaaatatgacaatgtccatgagcatgatcttggtaggagtgatcatgatgtttctgtctctgggagttggggcggatcaaggatgcgccatcaactttggcaag

SEQ ID NO: 626 - RNA, 2091 nt, synthetic construct
  misc_feature 1..2091: note = derived and/or modified CDS sequence (wt) from YFV__JX898869__X-SS-prME-XX
  source 1..2091: mol_type = other RNA
atgagagggttgtcctcaaggaaacgccgttcccacgatgtcctgactgtgcaatttttgattctgggaatgctgctgatggcgggtggagtaaccttggtgcggaaaaacagatggctactcctgaatgtgacatctgaggaccttgggaagaccttttctgtgggtacgggcaactgcacaacaaacatcttggaagccaagtattggtgtccagattcaatggaatacaactgtcccaacctcagtccaagagaggagccggatgacattgattgttggtgttacggagtggaaaatgtcagagttgcatatggcaagtgtgactcagcaggcaggtcaagaaggtcaagaagagctattgacttgcccacacatgaaaaccatggcctgaagactcggcaagaaaaatggatgactggaagaatgggggagaggcaactccaaaagattgagagatggcttgtgaggaatcccttctttgcagtaacagccttgaccatcgcctatcttgtgggtagcaacatgacgcagcgagtcgtgattgccctcctggttttggctgttggtccggcttactcagcccactgcattggaatcactgatagggatttcattgagggggtgcatggaggaacctgggtttcagccaccttggagcaagacaagtgtgtcactgtcatggcccctgacaagccttcactggatatttcactagagacagtggccattgacggaccagctgaggcgagaaaggtgtgttacaatgcagtcctcactcatgtgaagatcaatgacaagtgccctagcactggtgaggcccacctagctgaggaaaatgagggggacaatgcgtgtaagcgcacttattcggatagaggctggggaaacggctgtggcctgttcgggaaaggaagcattgtggcatgcgccaaattcacttgtgccaaatccatgagcttgtttgaggttgaccagacaaagatccagtacgtcatcagagcacaactgcatgttggggcaaagcaggaaaattggaacaccgacatcaaaactctcaagtttgatgcattgtcaggctctcaggaagccgagttcactgggtatggaaaagctactctggaatgccaggtgcaaactgcagtagactttggcaacagttacatcgctgagatggaaaaggagagctggatagtggacaggcaatgggctcaggacttaaccttaccatggcagagcggcagtggtggggtgtggagggaaatgcaccaccttgttgaatttgaacctccccatgctgcaaccatcagagtgctggccctaggaaaccaggaaggctctttaaaaacagccctcacaggtgcaatgagggttacaaaggacacgaatgacaacaatctgtacaaactacatggcggacatgtctcctgtagagtgaaattgtcagctttaacactcaaagggacatcctacaagatgtgcactgacaagatgtcttttgtcaagaacccgactgacactggccatggcactgttgtgatgcaggttaaagtgccaaaaggagctccctgcaagatcccagtgatagtagctgatgatcttacagcggcagtcaacaaaggcattttggttacagtcaaccccatcgcctcaaccaatgatgatgaagtgttgatcgaagtgaatccaccctttggagatagttacatcatagttggaacaggagattcacgtctcacctatcagtggcacaaagagggaagttcaataggaaagctgttcacccagactatgaaaggcgcagagcgcctggctgtcatgggagacgctgcctgggatttcagctctgctggagggttcttcacttcgattgggaaaggaattcacacggtgtttggctctgcctttcagggactttttggtggcttgagctggataacgaaggtcatcatgggcgcggtcctcatatgggtcggcatcaacacaaggaatatgacaatgtccatgagcatgatcttagtaggagtgattatgatgttcttgtctctgggagttggggcggatcaaggatgcgcaatcaactttggcaag

SEQ ID NO: 627 - RNA, 2091 nt, synthetic construct
  misc_feature 1..2091: note = derived and/or modified CDS sequence (wt) from YFV__JX898873__X-SS-prME-XX
  source 1..2091: mol_type = other RNA
atgagaggactgtcctcaaggaaacgccgttcccatgacgctctgactgtgcaactcctaattctgggaatgatattgatggcgggtggagtgaccttggtgcggaaaaacagatggttgctcctaaatgtgacatctgaggacctcgggaaaacattctccgtgggcacaggcaactgcactacaaacatcttggaagccaagtactggtgcccagattcaatggaatacaactgtcctaatctcagtccaagagaggagccagatgacattgattgctggtgctatggggtggaaaacgttagagtcgcatatggcaagtgtgactcagcaggcaggtctaggaggtcaagaagggctattgacttgcctacgcatgaaaaccatggcttgaagacccggcaagaaaaatggatgactggaagaatgggtgaaaggcagctccaaaagattgagagatggcttgtgaggaatcccttttttgcagtgacggctttgactattgcctaccttgtgggaagcaacatgacgcaacgggtcgtgattgccctactggtcctggctgttggtccggcctactcagctcactgcattggaattaccgacagggatttcattgagggggtgcatggaggaacctgggtttcagccactctggagcaagacaagtgtgtcactgtcatggcccctgacaagccttcattggacatttcactagagacagtagccattgatggacctgctgaggcgaggaaagtgtgttacaatgcagtcctcacccatgtgaagattaatgacaagtgccccagcaccggagaggctcacctagctgaagagaacgagggggacaatgcgtgcaagcgtacttattctgatagaggctggggtaatggttgtggcctgtttgggaaagggagcattgtggcatgcgccaaattcacttgtgccaaatccatgagcttgtttgaggttgatcagaccaagatccagtatgtcatcagagcacaattgcatgttggggctaagcaggaaaattggaataccgatatcaaaactctcaagtttgatgccctatcaggctcccaggaggccgagttcactgggtatggaaaagccacactcgaatgccaggtgcaaactgcggtggactttggcaatagttacatcgctgagatggaaaaagagagctggatagtggacagacagtgggctcaggacttgaccctgccatggcagagcggaagtggcggggtgtggagagagatgcatcatcttgttgaatttgaacctccgcatgccgcaactatcagagtgctggccctggggaaccaggaaggctccttgaaaacagctcttaccggtgcaacgagggttacaaaggacacgaatgacaacaacctttacaaactacatggtggacatgtctcttgcagagtgaaattgtcagccttgacactcaaggggacatcctacaaaatgtgcactgacaaaatgtcctttgtcaagaacccaactgacactggtcatggcactgttgtgatgcaggtgaaagtgccaaaaggagccccctgcaagatcccagtgatagtagctgatgatctcacagcggcaatcaataaaggtatcctggttacagtcaatcccatcgcttcaaccaatgatgatgaagtgctgattgaggtgaacccaccctttggagatagctacatcatcgtcgggacaggagattcacgtctcacctatcagtggcataaagaggggagttcaataggaaagctgttcactcagaccatgaaaggcgcggaacgcctagctgtcatgggagacgccgcctgggattttagctcagctggagggttctttacctcggttgggaaaggaattcatacggtgtttggctccgcctttcaggggctatttggtggcttgagctggataacgaaggtcatcatgggggcggtactcatatgggttggcatcaacacaagaaatatgacaatgtccatgagcatgatcttggtaggagtgatcatgatgtttctgtctctgggagttggggcggatcaaggatgcgccatcaactttggcaag

SEQ ID NO: 628 - RNA, 2091 nt, synthetic construct
  misc_feature 1..2091: note = derived and/or modified CDS sequence (wt) from YFV__JX898874__X-SS-prME-XX
  source 1..2091: mol_type = other RNA
atgagaggactgtcctcaaggaaacgccgttcccatgacgctctgactgtgcaactcctaattctgggaatgatattgatggcgggtggagtgaccttggtgcggaaaaacagatggttgctcctaaatgtgacatctgaggacctcgggaaaacattctccgtgggcacaggcaactgcactacaaacatcttggaagccaagtactggtgcccagattcaatggaatacaactgtcctaatctcagtccaagagaggagccagatgacattgattgctggtgctatggggtggaaaacgttagagtcgcatatggcaagtgtgactcagcaggcaggtctaggaggtcaagaagggctattgacttgcctacgcatgaaaaccatggcttgaagacccggcaagaaaaatggatgactggaagaatgggtgaaaggcagctccaaaagattgagagatggcttgtgaggaatcccttttttgcagtgacggctttgactattgcctaccttgtgggaagcaacatgacgcaacgggtcgtgattgccctactggtcctggctgttggtccggcctactcagctcactgcattggaattaccgacagggatttcattgagggggtgcatggaggaacctgggtttcagccactctggagcaagacaagtgtgtcactgtcatggcccctgacaagccttcattggacatttcactagagacagtagccattgatggacctgctgaggcgaggaaagtgtgttacaatgcagtcctcacccatgtgaagattaatgacaagtgccccagcaccggagaggctcacctagctgaagagaacgagggggacaatgcgtgcaagcgtacttattctgatagaggctggggtaatggttgtggcctgtttgggaaagggagcattgtggcatgcgccaaattcacttgtgccaaatccatgagcttgtttgaggttgatcagaccaagatccagtatgtcatcagagcacaattgcatgttggggctaagcaggaaaattggaataccgatatcaaaactctcaagttcgatgccctatcaggctcccaggaggccgagttcactgggtatggaaaagccacactcgaatgccaggtgcaaactgcggtggactttggcaatagttacatcgctgagatggaaaaagagagctggatagtggacagacagtgggctcaggacttgaccctgccatggcagagcggaagtggcggggtgtggagagagatgcatcatcttgttgaatttgaacctccgcatgccgcaactatcagagtgctggccctggggaaccaggaaggctccttgaaaacagctcttaccggtgcaatgagggttacaaaggacacgaatgacaacaacctttacaaactacatggtggacatgtctcttgcagagtgaaattgtcagccttgacactcaaggggacatcctacaaaatgtgcactgacaaaatgtcctttgtcaagaacccaactgacactggtcatggcactgttgtgatgcaggtgaaagtgccaaaaggagccccctgcaagatcccagtgatagtagctgatgatctcacagcggcaatcaataaaggtatcctggttacagtcaatcccatcgcttcaaccaatgatgatgaagtgctgattgaggtgaacccaccctttggagatagctacatcatcgtcgggacaggagattcacgtctcacctatcagtggcataaagaggggagttcaataggaaagctgttcactcagaccatgaaaggcgcggaacgcctagctgtcatgggagacgccgcctgggattttagctcagctggagggttctttacctcggttgggaaaggaattcatacggtgtttggctccgcctttcaggggctatttggtggcttgagctggataacgaaggtcatcatgggggcggtactcatatgggttggcatcaacacaagaaatatgacaatgtccatgagcatgatcttggtaggagtgatcatgatgtttctgtctctgggagttggggcggatcaaggatgcgccatcaactttggcaag

SEQ ID NO: 629 - RNA, 2091 nt, synthetic construct
  misc_feature 1..2091: note = derived and/or modified CDS sequence (wt) from YFV__JX898875__X-SS-prME-XX
  source 1..2091: mol_type = other RNA
atgagaggactgtcctcaaggaaacgccgttcccatgacgctctgactgtgcaactcctaattctgggaatgatattgatggcgggtggagtgaccttggtgcggaaaaacagatggttgctcctaaatgtgacatctgaggacctcgggaaaacattctccgtgggcacaggcaactgcactacaaacatcttggaagccaagtactggtgcccagattcaatggaatacaactgtcccaatctcagtccaagagaggagccagatgacattgattgctggtgctatggggtggaaaacgttagagtcgcatatggcaagtgtgactcagcaggcaggtctaggaggtcaagaagggctattgacttgcctacgcatgaaaaccatggcttgaagacccggcaagaaaaatggatgactggaagaatgggtgaaaggcagctccaaaagattgagagatggcttgtgaggaatcccttttttgcagtgacggctttgactattgcctaccttgtgggaagcaacatgacgcaacgggtcgtgattgccctactggtcctggctgttggtccggcctactcagctcactgcattggaattaccgacagggatttcattgagggggtgcatggaggaacctgggtttcagccactctggagcaagacaagtgtgtcactgtcatggcccctgacaagccttcattggacatttcactagagacagtagccattgatggacctgctgaggcgaggaaagtgtgttacaatgcagtcctcacccatgtgaagattaatgacaagtgccccagcaccggagaggctcacctagctgaagagaacgagggggacaatgcgtgcaagcgtacttattctgatagaggctggggtaatggttgtggcctgtttgggaaagggagcattgtggcatgcgccaaattcacttgtgccaaatccatgagcttgtttgaggttgatcagaccaagatccagtatgtcatcagagcacaattgcatgttggggctaagcaggaaaattggaataccgatatcaaaactctcaagtttgatgccctatcaggctcccaggaggccaagttcactgggtatggaaaagccacactcgaatgccaggtgcaaactgcggtggactttggcaatagttacatcgctgagatggaaaaagagagctggatagtggacagacagtgggctcaggacttgaccctgccatggcagagcggaagtggcggggtgtggagagagatgcatcatcttgttgaatttgaacctccgcatgccgcaactatcagagtgctggccctggggaaccaggaaggctccttgaaaacagctctcaccggtgcaatgagggttacaaaggacacgaatgacaacaacctttacaaactacatggtggacatgtctcttgcagagtgaaattgtcagccttgacactcaaggggacatcctacaaaatgtgcactgataaaatgtcctttgtcaagaacccaactgacactggtcatggcactgttgtgatgcaggtgaaagtgccaaaaggagccccctgcaagatcccagtgatagtagctgatgatctcacagcggcaatcaataaaggtatcctggttacagtcaatcccatcgcttcaaccaatgatgatgaagtgctgattgaggtgaacccaccctttggagatagctacatcatcgtcgggacaggagattcacgtctcacctatcagtggcataaagaggggagttcaataggaaagctgttcactcagaccatgaaaggcgcggaacgcctagctgtcatgggagacgccgcctgggattttagctcagctggagggttctttacctcggttgggaaaggaattcatacggtgtttggctctgcctttcaggggctatttggtggcttgagctggataacgaaggtcatcatgggggcggtactcatatgggttggcatcaacacaagaaatatgacaatgtccatgagcatgatcttggtaggagtgatcatgatgtttctgtctctgggagttggggcggatcaaggatgcgccatcaactttggcaag

SEQ ID NO: 630 - RNA, 2091 nt, synthetic construct
  misc_feature 1..2091: note = derived and/or modified CDS sequence (wt) from YFV__JX949181__X-SS-prME-XX
  source 1..2091: mol_type = other RNA
atgagaggattgtcctcaaggaaacgccgttcccatgatgttctgactgtgcaattcctaattttgggaatgctgttgatgacgggtggagtgaccttggtgcggaaaaacagatggttgctcctaaatgtgacatctgaggacctcgggaaaacattctctgtgggcacaggcaactgcacaacaaacattttggaagccaagtactggtgcccagactcaatggaatacaactgtcccaatctcagtccaagagaggagccagatgacattgattgctggtgctatggggtggaaaacgttagagtcgcatatggtaagtgtgactcagcaggcaggtctaggaggtcaagaagggccattgacttgcctacgcatgaaaaccatggtttgaagacccggcaagaaaaatggatgactggaagaatgggtgaaaggcaactccaaaagattgagagatggttcgtgaggaaccccttttttgcagtgacggctctgaccattgcctaccttgtgggaagcaacatgacgcaacgagtcgtgattgccctactggtcttggctgttggtccggcctactcagctcactgcattggaattactgacagggatttcattgagggggtgcatggaggaacttgggtttcagctaccctggagcaagacaagtgtgtcactgttatggcccctgacaagccttcattggacatctcactagagacagtagccattgatagacctgctgaggtgaggaaagtgtgttacaatgcagttctcactcatgtgaagattaatgacaagtgccccagcactggagaggcccacctagctgaagagaacgaaggggacaatgcgtgcaagcgcacttattctgatagaggctggggcaatggctgtggcctatttgggaaagggagcattgtggcatgcgccaaattcacttgtgccaaatccatgagtttgtttgaggttgatcagaccaaaattcagtatgtcatcagagcacaattgcatgtaggggccaagcaggaaaattggactaccgacattaagactctcaagtttgatgccctgtcaggctcccaggaagtcgagttcattgggtatggaaaagctacactggaatgccaggtgcaaactgcggtggactttggtaacagttacatcgctgagatggaaacagagagctggatagtggacagacagtgggcccaggacttgaccctgccatggcagagtggaagtggcggggtgtggagagagatgcatcatcttgtcgaatttgaacctccgcatgccgccactatcagagtactggccctgggaaaccaggaaggctccttgaaaacagctcttactggcgcaatgagggttacaaaggacacaaatgacaacaacctttacaaactacatggtggacatgtttcttgcagagtgaaattgtcagctttgacactcaaggggacatcctacaaaatatgcactgacaaaatgttttttgtcaagaacccaactgacactggccatggcactgttgtgatgcaggtgaaagtgtcaaaaggagccccctgcaggattccagtgatagtagctgatgatcttacagcggcaatcaataaaggcattttggttacagttaaccccatcgcctcaaccaatgatgatgaagtgctgattgaggtgaacccaccttttggagacagctacattatcgttgggagaggagattcacgtctcacttaccagtggcacaaagagggaagctcaataggaaagttgttcactcagaccatgaaaggcgtggaacgcctggccgtcatgggagacaccgcctgggatttcagctccgctggagggttcttcacttcggttgggaaaggaattcatacggtgtttggctctgcctttcaggggctatttggcggcttgaactggataacaaaggtcatcatgggggtggtacttatatgggttggcatcaacacaagaaacatgacaatgtccatgagcatgatcttggtaggagtgatcatgatgtttttgtctctaggagttggggcggatcaaggatgcgccatcaactttggcaag

SEQ ID NO: 631 - RNA, 2091 nt, synthetic construct
  misc_feature 1..2091: note = derived and/or modified CDS sequence (wt) from YFV__AY968064__X-SS-prME-XX
  source 1..2091: mol_type = other RNA
atgagaggactgtcttccaggaaacgtagatccaatgaaatggccttgtttccactcttgttactgggtttgttggctctatcaggaggagtgaccctcgtcagaaagaacagatggttgctcttgaatgtaactgctgaagatctggggaaaacgttttcagtgggaactgggaattgcaccacgaatattctggaagcaaaatactggtgccccgactcaatggagtacaattgtcccaatctcagtccaagagaagagccagatgacatagattgctggtgttatggagtggaaaatgtcagagtggcctatggaagatgtgatgcggtagggcgatcaaaacgttctaggagagcgattgatctacccacacatgagaaccatggactaaagactcggcaggagaagtggatgactggcagaatgggtgagaggcagctccagaagattgaaagatggctggttaggaatccattttttgcggtcacagcattggcaatagcctatctggtgggtaacaacacgacgcaacgagtggtaatagcactactggttctagcggttggtccagcgtactctgcccattgcatagggataaccgacagagatttcattgaaggtgtccatgggggcacttgggtgtcagccactctggagcaggacaaatgcgtgactgtaatggcccctgacaaaccttctctagacatctcactacagacagtggcaatcgatggaccggctgaagcgaggaaggtttgctacagtgcagtcctaacccatgtgaaaatcaatgacaaatgcccgagcactggtgaggctcaccttgcagaggaaaatgatggtgacaatgcttgcaaacggacatattctgacagaggctggggcaatggctgtggtctatttgggaaagggagcattgtggcttgtgctaagttcacatgtgccaaatctatgagtctctttgaggtggatcagaccaagattcaatatgtcatcagggctcagctccatgtgggtgccaaacaggaaaactggaacacagacataaaaacgctgaaatttgatgctctttctggctcacaggaggctgaattcactggttatggaaaagcaacactggagtgtcaggtccagactgccgtggactttgggaacagctacatcgcagagatggaaaaagatagctggatcgttgaccgccaatgggcacaggacttgacactgccatggcagagtgggagtggtggcatatggagagaaatgcaccaccttgttgagtttgagcccccacatgctgccacaattagggtgctggccttgggcaatcaagaaggctccttgaagaccgctctcacaggcgccatgcgcgtcaccaaggatgagaatgacaacaacttgtacaaactgcacggtggtcacgtctcctgtagagtgaaactgtcagctctcactctcaaaggaacatcctacaagatgtgtacagacaagatgtcatttgtcaagaatccgacggatacagggcatggcacagttgtcatgcaagtaaaggtccccaaaggggccccatgcaagattcccgtgattgtggcagatgacctaacggctgcggtgaacaaaggcatcttggtcactgtcaatcctattgcatccacaaatgatgatgaagttctgattgaggtcaatcccccttttggggatagctacatcatagttgggactggagattcacgactgacctatcagtggcacaaagaagggagttcaataggaaaattgtttacacagacaatgaaaggagctgaacgtcttgcagtgatgggtgatgctgcttgggattttagttctgctggggggttcttcacatctgtgggaaaaggaatccataccgtgtttggctcggccttccaggggctgtttggtggcttgagttggattacgaaagtcatcatgggagccgtactcatctgggtgggaataaacacccgcaacatgaccatgtccatgtccatgatcttggtaggtgtgatcatgatgtttctttcattgggagttggggctgaccaaggatgtgctgtcaactttgggaaa

SEQ ID NO: 632 - RNA, 2091 nt, synthetic construct
  misc_feature 1..2091: note = derived and/or modified CDS sequence (wt) from YFV__AY968065__X-SS-prME-XX
  source 1..2091: mol_type = other RNA
atgagagggttgtcttctaggaagcgtcgctccagtgagatgaccatgatgccacttctgatcttgagcatggtgattctaggtggaggggtgacactcgtccggaaaaatcgatggctgcttttgaatgtcacagctgaggacttgggaaagacgttctcggtgggaaccgggaactgcacaaccaacattcttgaggcaaagtactggtgtcccgattcaatggaatacaactgtcccaatctcagtcctagagaggagcctgatgacattgactgttggtgttatggagtagaaaacgtcagagtagcctatggaaggtgtgatgcagtgggaaggtcaaaacgttctaggagagcaattgatctgcccacacatgaaaatcacggactgaaaactcgacaggagaaatggatgacgggcagaatgggtgagcggcaactccaaaagattgagcggtggctagtgagaaatccattctttgccgtaacagccctggccattgcttacttggtgggcaacaacaagacacaacgtgttgttatagctctgttggttttggcagttggtccggcctattctgcacactgcattgggataactgacagagacttcattgagggggtccacggaggcacttgggtgtcagcttctctggagcaggacaagtgcgtgactgtcatggcgcctgataaaccatcactggatatctcgcttcaaacagtggcgatagatgggcctgctgaggcaaggaaggtctgctacagtgcagttctcacccatgtgaaaatcaatgacaaatgcccgagcaccggtgaggctcacctcgctgaggaaaatgatggtgataacgcctgcaaacggacatactcagatagaggctggggcaatggctgtgggctatttgggaaagggagcattgtggcatgtgccaagttcacgtgtgctaaatccatgagtctttttgaagtggaccagaccaagatccaatacgtcatcagggctcagcttcatgttggtgccaagcaggagaactggaacacagatataaaaacactgaagtttgatgccttatctggctcccaagaggctgaattcactggctatgggaaagcaacactggaatgtcaggtccagactgcagtggattttgggaacagttacattgcagagatggaaaaagacagctggattgtcgaccgccagtgggcacaagacttgactctaccatggcagagtgggagtggtggaatatggagggaaatgcatcaccttgttgagtttgaacctccgcatgctgccacaatcagggtgttggccctggggaaccaagaggggtccttgaagacagccctcacaggagctatgcgggttaccaaggacgaaaatgataacaacttgtataagctgcatggtggccatgtctcttgtagggtgaaactttcagctctaacccttaaggggacatcctacaagatgtgcacagataaaatgtcatttgtgaaaaacccaacggacacagggcatggcactgttgtcatgcaggtgaaggtccccaaaggagccccatgcaagattcccgtgattgtggccgatgacctaacggctgcagtcaacaagggaatattggtcactgtcaaccccatagcatccacaaatgacgatgaagttctaattgaagtcaatcccccctttggggacagttacatcattgttgggactggtgactcaagactgacctatcagtggcacaaagaaggaagttcaataggaaaacttttcactcagacaatgaagggagtagaacgtcttgcagtaatgggtgatgctgcctgggactttagctctgcaggtggcttcttcacgtcagtggggaaaggaattcacactgtgtttggttcagcttttcaggggttgtttggcggcctgagctggattacaaaggtcatcatgggagccgttctcatctgggttggaatcaacacacgtaatatgaccatgtccatgtctatgattttggtgggtgtgatcatgatgttcctttccctgggtgtcggggcagaccaagggtgtgccgtcaactttgggaag

SEQ ID NO: 633 - RNA, 2061 nt, synthetic construct
  misc_feature 1..2061: note = derived and/or modified CDS sequence (opt1) from YFV__L06480__X-SS-prME-XX
  source 1..2061: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggcccggaaggtgtgctacaacgcggtcctgacccacgtgaagatcaacgacaagtgcccctccaccggcgaggcccacctcgccgaggagaacgagggggacaacgcctgcaagcgcacctacagcgaccgcggctgggggaacggctgcgggctgttcggcaagggctccatcgtggcctgcgcgaagttcacgtgcgccaagagcatgtccctgttcgaggtcgaccagaccaagatccagtacgtgatccgggcccagctccacgtcggggccaagcaggagaactggaacaccagcatcaagaccctgaagttcgacgccctgagcggctcccaggaggtggagttcatcgggtacggcaaggcgacgctcgagtgccaggtgcagaccgccgtcgacttcgggaacagctacatcgccgagatggagaccgagtcctggatcgtggaccgccagtgggcccaggacctgaccctgccctggcagagcggctccggcggggtgtggcgggagatgcaccacctcgtcgagttcgagcccccgcacgccgcgacgatccgcgtgctggccctgggcaaccaggaggggagcctcaagaccgccctgaccggcgccatgcgggtgaccaaggacacgaacgacaacaacctgtacaagctccacgggggccacgtctcctgccgcgtgaagctgagcgcgctgaccctcaagggcacctcctacaagatctgcaccgacaagatgttcttcgtgaagaaccccacggacaccgggcacggcaccgtcgtgatgcaggtcaaggtgcccaagggggccccctgccggatcccggtgatcgtggccgacgacctgaccgccgccatcaacaagggcatcctggtcaccgtgaaccccatcgcgagcacgaacgacgacgaggtgctcatcgaggtcaacccgcccttcggcgactcctacatcatcgtggggcgcggcgacagccggctgacctaccagtggcacaaggaggggtccagcatcggcaagctgttcacccagaccatgaagggggtggagcgcctcgccgtcatgggcgacgtggcctgggacttctccagcgccggcgggttcttcacgtccgtgggcaaggggatccacaccgtcttcggcagcgccttccaggggctgttcggcggcctgaactggatcaccaaggtgatcatgggggcggtgctgatctgggtcggcatcaacacccggaacatgacgatgtccatgagcatgatcctcgtgggggtgatcatgatgttcctgagcctgggcgtcggggcc

SEQ ID NO: 634 - RNA, 2091 nt, synthetic construct
  misc_feature 1..2091: note = derived and/or modified CDS sequence (opt1) from YFV__D14458__X-SS-prME-XX
  source 1..2091: mol_type = other RNA
atgcgcggcctgagctcccggaagcgccggagctacgaggtgctcaccgtccagttcctgatcctggggatgctcctgatgaccggcggggtgacgctggtgcgcaagtcccggtggctcctgctgaacgtcaccagcgaggacctcggcaagaccttctccgtggggaccggcaactgcacgaccaacatcctggaggccaagaactggtgccccgacagcatggagtacaactgccccaacctgagcccccgcgaggagcccgacgacatcgactgctggtgctacggcgtggagaacgtccgggtggcctacgggaagtgcgactccgcgggccgctcccggcgcagccggcgcgccatcgacctccccacccacgagaaccacgggctgaagacccggcaggagaagtggatgacgggccgcatgggggagcggcagctgcagaagatcgagcgctggctcgtgcggaacccgttcttcgccgtcaccgccctggccatcgcgtacctggtgggctccaacatgacccagcgcgtggtcatcgccctcctggtgctggccgtgggccccgcctacagcgcgcactgcatcgggatcaccgaccgggacttcatcgagggcgtccacgggggcacgtgggtgtccgccaccctcgagcaggacaagtgcgtgaccgtcatggcccccgacaagcccagcctggacatctccctggagaccgtggccatcgacggcccggccgaggcgcgcaaggtgtgctacagcgccgtcctcacgcacgtgaagatcaacgacaagtgcccctccaccggggaggcccacctggccgaggagaacgagggcgaccacgcctgcaagcggacctacagcgaccgcgggtggggcaacgggtgcggcctgttcggcaaggggtccatcgtggcgtgcgccaagttcacgtgcgccaagagcatgagcctcttcgaggtcgaccagaccaagatccagtacgtgatccgcgcccagctgcacgtcggcgccaagcaggagaactggaacgcggacatcaagaccctgaagttcgacgccctctccgggagccaggaggccgagttcaccggctacgggaaggccaccctggagtgccaggtgcagacggccgtggacttctccaacagctacatcgcggagatggagaaggagtcctggatcgtcgaccggcagtgggcccaggacctgaccctcccctggcagagcggctccggcggggtgtggcgcgagatgcaccacctggtggagttcgagcccccgcacgccgccaccatcaaggtcctggcgctcggcaaccaggaggggagcctgaagaccgccctgacgggcgccatgcgggtgaccaaggacaccaacgggtccaacctctacaagctgcacggcggccacgtgagctgccgcgtcaagctgtccgccctcaccctgaaggggacgagctacaagatgtgcaccgacaagatgtccttcgtgaagaaccccaccgacaccggccacgggacggccgtgatgcaggtcaaggtgcccaagggcgcgccctgccggatcccggtgatggtcgccgacgacctgaccgccagcgtgaacaagggcatcctcgtgaccgtcaaccccatcgcctccaccaacgaggacgaggtgctgatcgaggtgaacccgcccttcggggacagctacatcatcgtcggcaccggggactcccgcctgacgtaccagtggcacaaggagggcagctccatcgggaagctgttcacccagaccatgaagggcgccgagcggctcgcggtgatgggcgacgccgcctgggacttcagcagcgccgggggcttcttcacctccgtggggaagggcatccacatggtcttcgggagcgccttccagggcctgttcggcgggctgtcctggatcacgaaggtgatcatgggcgcggtgctcatctgggtcgggatcaacatgcgcaacatgaccatgagcatgtccatgatcctggtgggcgtgatcatgatgttcctgagcctcggggtcggcgccgaccagggctgcgccatcaacttcgggaag

SEQ ID NO: 635 - RNA, 2091 nt, synthetic construct
  misc_feature 1..2091: note = derived and/or modified CDS sequence (opt1) from YFV__U21055__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcatggggaccggcaactgcacgaccaacatcctggaggccaagtactggtgccccgactccatggagtacaactgccccaacctgagcccccgcgaggagcccgacgacatcgactgctggtgctacggcgtggagaacgtgcgggtcgcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtgaccgccctcaccatcgcctacctggtcggcagcaacatgacccagcgcgtggtgatcgcgctgctcgtcctggccgtgggccccgcctactccgcccactgcatcgggatcacggaccgggacttcatcgagggcgtgcacgggggcacctgggtcagcgcgaccctggagcaggacaagtgcgtgaccgtgatggcccccgacaagccctccctcgacatcagcctggagacggtcgccatcgacggcccggtggaggcccgcaaggtgtgctacaacgccgtcctgacccacgtgaagatcaacgacaagtgcccctccaccggggaggcgcacctcgccgaggagaacgagggcgacaacgcctgcaagcggacctacagcgaccgcgggtggggcaacgggtgcggcctgttcggcaaggggtccatcgtggcctgcgccaagttcacgtgcgccaagagcatgtccctgttcgaggtcgaccagaccaagatccagtacgtgatccgcgcgcggctccacgtcggcgccaagcaggagaactggaagaccgacatcaagaccctgaagttcgacgccctgagcgggagccaggaggccgagttcacgggctacgggaaggcgaccctcgagtgccaggtgcagaccgccgtggacttcggcaactcctacatcgccgagatggagaaggagagctggatcgtcgaccgccagtgggcccaggacctgaccctgccctggcagtccggcagcgggggcgtgtggcgggagatgcaccacctcgtggagttcgagcccccgcacgccgcgacgatccgcgtcctggccctgggggaccaggagggctccctcaagaccgccctgaccggggccatgcgggtgaccaaggacacgaacgacaacaacctgtacaagctccacggcggccacgtgagctgccgcgtcaagctgtccgcgctgaccctcaaggggaccagctacaagatgtgcaccgacaagatgtccttcgtgaagaaccccacggacaccggccacgggaccgtggtcatgcaggtcaaggtgcccaagggcgccccctgccggatcccggtgatcgtggccgacgacctgaccgccgccatcaacaagggcatcctggtgaccgtcaaccccatcgcgagcacgaacgacgacgaggtgctcatcgaggtgaacccgcccttcggggactcctacatcatcgtcggcaccggggacagccgcctgacctaccagtggcacaaggagggctccagcatcgggaagctgttcacccagacgatgaagggcgccgagcggctcgccgtgatgggcgacgccgcctgggacttctccagcgccgggggcttcttcacctccgtggggaagggcatccacaccgtcttcgggagcgcgttccagggcctgttcggcgggctgaactggatcaccaaggtgatcatcggcgccgtgctgatctgggtcgggatcaacacgcgcaacatgaccatgtccatgagcatgatcctcgtgggcgtgatcatgatgttcctgagcctgggggtcggcgccgaccagggctgcgccatcaacttcgcgaag

SEQ ID NO: 636 - RNA, 2091 nt, synthetic construct
  misc_feature 1..2091: note = derived and/or modified CDS sequence (opt1) from YFV__U21056__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggctcgtgcggaacccgttcttcgccgtcaccgccctgaccatcgcctacctggtgggcagcaacatgacccagcgcgtggtcatcgcgctcctggtgctggccgtgggccccgcctactccgcccactgcatcgggatcacggaccgggacttcatcgagggcgtccacgggggcacctgggtgagcgcgaccctcgagcaggacaagtgcgtgaccgtcatggcccccgacaagccctccctggacatcagcctggagacggtggccatcgacggcccggccgaggcccgcaaggtgtgctacaacgcggtcctcacccacgtgaagatcaacgacaagtgcccctccaccggggaggcccacctggccgaggagaacgagggcgacaacgcctgcaagcggacctacagcgaccgcgggtggggcaacgggtgcggcctgttcggcaaggggtccatcgtggcctgcgcgaagttcacgtgcgccaagagcatgtccctcttcgaggtcgaccagaccaagatccagtacgtgatccgcgcccagctgcacgtcggcgccaagcaggagaactggaacaccgacatcaagaccctgaagttcgacgccctcagcgggagccaggaggcggagttcacgggctacgggaaggccaccctggagtgccaggtgcagaccgccgtggacttcggcaactcctacatcgccgagatggagaaggagagctggatcgtcgaccggcagtgggcccaggacctgaccctcccctggcagtccggcagcgggggcgtgtggcgcgggatgcaccacctggtggagttcgagcccccgcacgcggccacgatccgggtcctggccctcggcaaccaggaggggtccctgaagaccgccctgaccggcgcgatgcgcgtgaccaaggacacgaacgacaacaacctctacaagctgcacggcgggcacgtgagctgccgggtcaagctgtccgccctcaccctgaagggcaccagctacaagatgtgcaccgacaagatgtccttcgtgaagaaccccacggacaccgggcacggcaccgtggtcatgcaggtcaaggtgcccaagggcgccccctgccgcatcccggtgatcgtggccgacgacctgaccgccgcgatcaacaaggggatcctcgtgaccgtcaaccccatcgccagcacgaacgacgacgaggtgctgatcgaggtgaacccgcccttcggcgactcctacatcatcgtcgggaccggcgacagccggctgacctaccagtggcacaaggaggggtccagcatcggcaagctgttcacccagacgatgaagggcgtggagcgcctcgccgtgatgggggacgccgcctgggacttctccagcgcgggcgggttcttcacctccgtcggcaaggggatccacaccgtgttcggcagcgccttccagggcctgttcgggggcctgaactggatcaccaaggtgatcatgggggccgtcctcatctgggtgggcatcaacacgcggaacatgaccatgtccatgagcatgatcctggtgggggtcatcatgatgttcctgagcctcggcgtgggcgccgaccaggggtgcgccatcaacttcggcaag

SEQ ID NO: 637 - RNA, 2091 nt, synthetic construct
  misc_feature 1..2091: note = derived and/or modified CDS sequence (opt1) from YFV__U54798__X-SS-prME-XX
  source 1..2091: mol_type = other RNA
atgcgcggcctgagctcccggaagcgccggagccacgacgtgctcaccgtccagttcctgatcctggggatgctcctgatggccggcggggtgaccctggtgcgcaagaaccggtggctcctgctgaacgtcacgtccgaggacctcggcaagaccttcagcgtggggaccggcaactgcaccacgaacatcctggaggccaagtactggtgccccgactccatggagtacaactgccccaacctgagcccccgcgaggagcccgacgacatcgactgctggtgctacggcgtggagaacgtccgggtggcgtacgggaagtgcgactccgccggccgcagccggcgctcccggcgcgccatcgacctccccacccacgagaaccacgggctgaagacccggcaggagaagtggatgaccggccgcatgggggagcggcagctgcagaagatcgagcgctggctcgtgcggaacccgttcttcgccgtcacggccctggcgatcgcctacctggtgggcagcaacatgacccagcgcgtggtcatcgccctcctggtgctggccgtgggccccgcgtactccgcccactgcatcgggatcaccgaccgggacttcatcgagggcgtccacgggggcacctgggtgagcgccacgctcgagcaggacaagtgcgtgaccgtcatggcccccgacaagccctccctggacatcagcctggagaccgtggccatcgacggcccggcggaggcccgcaaggtgtgctacaacgccgtcctcacccacgtgaagatcaacgacaagtgcccctccacgggggaggcccacctggccgaggagaacgagggcgacaacgcgtgcaagcggacctacagcgaccgcgggtggggcaacgggtgcggcctgttcggcaaggggtccatcgtggcctgcgccaagttcacgtgcgccaagagcatgtccctcttcgaggtcgaccagaccaagatccagtacgtgatccgcgcccagctgcacgtcggcgcgaagcaggagaactggaacaccgacatcaagaccctgaagttcgacgccctcagcgggagccaggaggccgagttcaccggctacgggaaggccaccctggagtgccgggtgcagacggccgtggacttcggcaactcctacatcgcggagatggagaaggagagctggatcgtcgaccgccagtgggcccaggacctgaccctcccctggcagtccggcagcgggggcgtgtggcgggagatgcaccacctggtggagttcgagcccccgcacgccgccaccatccgcgtcctggcgctcgggaaccaggagggctccctgaagaccgccctgacgggggccatgcgggtgaccaaggacaccaacgacaacaacctctacaagctgcacggcggccacgtgagctgccgcgtcaagctgtccgccctcaccctgaaggggacgagctacaagatgtgcaccgacaagatgtccttcgtgaagaaccccaccgacaccgaccacggcacggtggtcatgcaggtcaaggtgcccaagggggccccctgcaagatcccggtgatcgtggcggacgacctgaccgccgccatcaacaagggcatcctcgtgaccgtcaaccccatcgccagcaccaacgacgacgaggtgctgatcgaggtgaacccgcccttcggcgactcctacatcatcgtcgggaccggcgacagccggctgacgtaccagtggcacaaggaggggtccagcatcggcaagctgttcacccagaccatgaagggggccgagcgcctcgcggtgatgggcgacgccgcctgggacttctccagcgccggcgggctgttcacctccatcggcaaggggagccacacggtgttcggctccgccttccaggggctgttcggcggcctcagctggatcaccaaggtcatcatgggggcggtgctgatctgggtgggcatcaacacccggaacatgaccatgagcatgtccatgatcctggtcggggtgatcatgatgttcctcagcctgggcgtgggggccgaccagggctgcgccatcaacttcggcaag

SEQ ID NO: 638 - RNA, 2061 nt, synthetic construct
  misc_feature 1..2061: note = derived and/or modified CDS sequence (opt1) from YFV__AF052440__X-SS-prME-XX
  source 1..2061: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaccaccgacatcaagacgctgaagttcgacgccctgagcggcagccaggaggtggagttcatcgggtacggcaaggccaccctcgagtgccaggtccagaccgcggtggacttcgggaactcctacatcgccgagatggagaccgagagctggatcgtggaccgccagtgggcccaggacctgacgctgccctggcagtccggcagcggcggggtctggcgggagatgcaccacctcgtggagttcgagcccccgcacgccgccaccatccgcgtgctggcgctgggcaaccaggaggggtccctcaagaccgccctgaccggcgccatgcgggtcacgaaggacaccaacgacaacaacctgtacaagctccacgggggccacgtgagctgccgcgtgaagctgtccgccctgaccctcaagggcaccagctacaagatctgcacggacaagatgttcttcgtcaagaaccccaccgacaccgggcacggcaccgtggtgatgcaggtcaaggtgtccaagggggcgccctgccggatccccgtgatcgtcgccgacgacctgaccgccgccatcaacaagggcatcctggtgacggtgaacccgatcgccagcaccaacgacgacgaggtcctcatcgaggtgaacccgcccttcggcgactcctacatcatcgtggggcgcggcgacagccggctgacctaccagtggcacaaggaggggtccagcatcggcaagctgttcacccagacgatgaagggggtcgagcgcctcgcggtgatgggcgacaccgcctgggacttctccagcgccggcgggttcttcacctccgtgggcaaggggatccacaccgtcttcggcagcgccttccaggggctgttcggcggcctgaactggatcacgaaggtgatcatgggggccgtgctgatctgggtcggcatcaacacccggaacatgaccatgtccatgagcatgatcctcgtgggggtgatcatgatgttcctgagcctgggcgtcggggcg

SEQ ID NO: 639 - RNA, 2091 nt, synthetic construct
  misc_feature 1..2091: note = derived and/or modified CDS sequence (opt1) from YFV__AF052445__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccgccagtgggcccaggacctgaccctgccctggcagtccggcagcggcggggtctggcgggagatgcaccacctcgtggagttcgagcccccgcacgccgccacgatccgcgtgctggcgctgggcaaccaggaggggtccctcaagaccgccctgaccggcgccatgcgggtcaccaaggacacgaacgacaacaacctgtacaagctccacgggggccacgtgagctgccgcgtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccggatccccgtgatcgtcgccgacgacctgaccgccgccatcaacaagggcatcctggtgaccgtgaacccgatcgccagcacgaacgacgacgaggtcctcatcgaggtgaacccgcccttcggcgactcctacatcatcgtggggcgcggcgacagccggctgacctaccagtggcacaaggaggggtccagcatcggcaagctgttcacccagaccatgaagggggtcgagcgcctcgcggtgatgggcgacacggcctgggacttctccagcgccggcgggttcttcacctccgtgggcaaggggatccacaccgtcttcggcagcgccttccaggggctgttcggcggcctgaactggatcaccaaggtgatcatgggggtggtcctgatctgggtgggcatcaacacgcggaacatgaccatgtccatgagcatgatcatggtgggggtcatcatgatgttcctcagcctgggcgtgggggccgaccagggctgcgcgatcaacttcggcaag

SEQ ID NO: 640 - RNA, 2091 nt, synthetic construct
  misc_feature 1..2091: note = derived and/or modified CDS sequence (opt1) from YFV__AF094612__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctgatgcgcaagaaccggtggctcctgctgaacgtgacctccgaggacctcggcaagaccttcagcatcgggaccggcaactgcacgaccaacatcctggaggccaagtactggtgccccgactccatggagtacaactgccccaacctgagcccccgcgaggagcccgacgacatcgactgctggtgctacggcgtcgagaacgtgcgggtgacctacgggaagtgcgactccgccggccgcagccggcgctcccggcgcgcgatcgacctccccacccacgagaaccacgggctgaagacgcggcaggagaagtggatgaccggccgcatgggggagcggcagctgcagaagatcgagcgctggttcgtccggaacccgttcttcgccgtgaccgccctcaccatcgcctacctggtgggcagcaacatgacgcagcgcgtcgtgatcgccctgctcgtgctggcggtcggccccgcctactccgcccactgcatcggggtggccgaccgggacttcatcgagggcgtgcacgggggcacctgggtcagcgcgaccctggagcaggacaagtgcgtgaccgtgatggcccccgacaagccctccctcgacatcagcctggagacggtcgccatcgacggcccggtggaggcccgcaaggtgtgctacaacgccgtcctgacccacgtgaagatcgacgacaagtgcccctccaccggggaggcgcacctcgccgaggagaacgagggcgacaacgcctgcaagcggacctacagcgaccgcgggtggggcaacgggtgcggcctgttcggcaaggggtccatcgtggcctgcgccaagttcacgtgcgccaagagcatgtccctgttcgaggtcgaccagaccaagatccagtacgtgatcaaggcgcagctccacgtcggcgccaagcaggaggactggaagaccgacatcaagaccctgaagttcgacgtgctgagcgggagccaggaggccgagttcacgggctacgggaaggtgaccctcgagtgccaggtccagaccgccgtggacttcggcaactcctacatcgcggagatggagaaggagagctggatcgtggaccgccagtgggcccaggacctgaccctgccctggcagtccggcagcgggggcgtctggcgggagatgcaccacctcgtggagttcgagcccccgcacgccgccacgatccgcgtgctggccctgggggaccaggagggctccctcaagaccgcgctgaccggggccatgcgggtcaccaaggacacgaacgacaacaacctgtacaagctccacggcggccacgtgagctgccgcgtgaagctgtccgccctgaccctcaaggggaccagctacaagatgtgcaccgacaagatgtccttcgtcaagaaccccacggacaccggccacgggaccgtggtgatgcaggtcaaggtgcccaagggcgccccctgcaagatcccggtgatcgtcgcggacgacctgaccgccgccatcaacaagggcatcctggtgaccgtgaaccccatcgccagcacgaacgacgacgaggtcctcatcgaggtgaacccgcccttcggggactcctacatcatcatcggcaccggggacagccggctgacctaccagtggcacaaggagggctccagcatcgggaagctgttcacccagacgatgaagggcgccgagcgcctcgcggtgatgggcgacgccgcctgggacttctccagcgccgggggcttcttcacctccgtcgggaagggcatccacaccgtgttcgggagcgccttccagggcctgttcggcgggctgaactggatcaccaaggtgatcatgggcgcggtcctgatctgggtggggttcaacacgcggaacatgaccatgtccatgagcatgatcctcgtgggcgtcatcatgatgttcctgagcctgggggtgggcgccgaccagggctgcgccatcaacttcgggaag

SEQ ID NO: 641 - RNA, 2091 nt, synthetic construct
  misc_feature 1..2091: note = derived and/or modified CDS sequence (opt1) from YFV__KF769015__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaccaccgacatcaagacgctgaagttcgacgccctgagcggcagccaggaggtggagttcatcgggtacggcaaggccaccctcgagtgccaggtccagaccgcggtggacttcgggaactcctacatcgccgagatggagaccgagagctggatcgtggaccgccagtgggcccaggacctgacgctgccctggcagtccggcagcggcggggtctggcgggagatgcaccacctcgtggagttcgagcccccgcacgccgccaccatccgcgtgctggcgctgggcaaccaggaggggtccctcaagaccgccctgaccggcgccatgcgggtcacgaaggacaccaacgacaacaacctgtacaagctccacgggggccacgtgagctgccgcgtgaagctgtccgccctgaccctcaagggcaccagctacaagatctgcacggacaagatgttcttcgtcaagaaccccaccgacaccgggcacggcaccgtggtgatgcaggtcaaggtgtccaagggggcgccctgccggatccccgtgatcgtcgccgacgacctgaccgccgccatcaacaagggcatcctggtgacggtgaacccgatcgccagcaccaacgacgacgaggtcctcatcgaggtgaacccgcccttcggcgactcctacatcatcgtggggcgcggcgacagccggctgacctaccagtggcacaaggaggggtccagcatcggcaagctgttcacccagacgatgaagggggtcgagcgcctcgcggtgatgggcgacaccgcctgggacttctccagcgccggcgggttcttcacctccgtgggcaaggggatccacaccgtcttcggcagcgccttccaggggctgttcggcggcctgaactggatcacgaaggtgatcatgggggccgtgctgatctgggtcggcatcaacacccggaacatgaccatgtccatgagcatgatcctcgtgggggtgatcatgatgttcctgagcctgggcgtcggggcggaccagggctgcgccatcaacttcggcaag

SEQ ID NO: 642 - RNA, 2091 nt, synthetic construct
  misc_feature 1..2091: note = derived and/or modified CDS sequence (opt1) from YFV__KF769016__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggctcgtgcggaacccgttcttcgccgtcaccgccctgaccatcgcctacctggtgggcagcaacatgacccagcgcgtggtcatcgcgctcctggtgctggccgtgggccccgcctactccgcccactgcatcgggatcacggaccgggacttcatcgagggcgtccacgggggcacctgggtgagcgcgaccctcgagcaggacaagtgcgtgaccgtcatggcccccgacaagccctccctggacatcagcctggagacggtggccatcgacggcccggccgaggcccgcaaggtgtgctacaacgcggtcctcacccacgtgaagatcaacgacaagtgcccctccaccggggaggcccacctggccgaggagaacgagggcgacaacgcctgcaagcggacctacagcgaccgcgggtggggcaacgggtgcggcctgttcggcaaggggtccatcgtggcctgcgcgaagttcacgtgcgccaagagcatgtccctcttcgaggtcgaccagaccaagatccagtacgtgatccgcgcccagctgcacgtcggcgccaagcaggagaactggaacaccgacatcaagaccctgaagttcgacgccctcagcgggagccaggaggcggagttcacgggctacgggaaggccaccctggagtgccaggtgcagaccgccgtggacttcggcaactcctacatcgccgagatggagaaggagagctggatcgtcgaccggcagtgggcccaggacctgaccctcccctggcagtccggcagcgggggcgtgtggcgcgagatgcaccacctggtggagttcgagcccccgcacgcggccacgatccgggtcctggccctcgggaaccaggagggctccctgaagaccgccctgaccggggcgatgcgcgtgaccaaggacacgaacgacaacaacctctacaagctgcacggcggccacgtgagctgccgggtcaagctgtccgccctcaccctgaaggggaccagctacaagatgtgcaccgacaagatgtccttcgtgaagaaccccacggacaccggccacgggaccgtggtcatgcaggtcaaggtgcccaagggcgccccctgcaagatcccggtgatcgtggccgacgacctgaccgccgcgatcaacaagggcatcctcgtgaccgtcaaccccatcgccagcacgaacgacgacgaggtgctgatcgaggtgaacccgcccttcggggactcctacatcatcgtcggcaccggggacagccgcctgacctaccagtggcacaaggagggctccagcatcgggaagctgttcacccagacgatgaagggcgccgagcggctcgccgtgatgggcgacgccgcgtgggacttctccagcgccgggggcttcttcacctccgtggggaagggcatccacaccgtcttcgggagcgccttccagggcctgttcggcgggctgaactggatcaccaaggtgatcatgggcgccgtgctcatctgggtcgggatcaacacgcgcaacatgaccatgtccatgagcatgatcctggtgggcgtgatcatgatgttcctgagcctcggggtcggcgccgaccagggctgcgcgatcaacttcgggaag

SEQ ID NO: 643 - RNA, 2091 nt, synthetic construct
  misc_feature 1..2091: note = derived and/or modified CDS sequence (opt1) from YFV__KF907504__X-SS-prME-XX
  source 1..2091: mol_type = other RNA
atgcgcggcctgagctcccggaagcgccggagccacgaggtgctcaccgtccagttcctgatcctggggatgctcctgatgaccggcggggtgacgctggtgcgcaagtcccggtggctcctgctgaacgtcaccagcgaggacctcggcaagaccttctccgtggggaccggcaactgcacgaccaacatcctggaggccaagaactggtgccccgacagcatggagtacaactgccccaacctgagcccccgcgaggagcccgacgacatcgactgctggtgctacggcgtggagaacgtccgggtggcctacgggaagtgcgactccgcgggccgctcccggcgcagccggcgcgccatcgacctccccacccacgagaaccacgggctgaagacccggcaggagaagtggatgacgggccgcatgggggagcggcagctgcagaagatcgagcgctggctcgtgcggaacccgttcttcgccgtcaccgccctggccatcgcgtacctggtgggctccaacatgacccagcgcgtggtcatcgccctcctggtgctggccgtgggccccgcctacagcgcgcactgcatcgggatcaccgaccgggacttcatcgagggcgtccacgggggcacgtgggtgtccgccaccctcgagcaggacaagtgcgtgaccgtcatggcccccgacaagcccagcctggacatctccctggagaccgtggccatcgacggcccggccgaggcgcgcaaggtgtgctacagcgccgtcctcacgcacgtgaagatcaacgacaagtgcccctccaccggggaggcccacctggccgaggagaacgagggcgaccacgcctgcaagcggacctacagcgaccgcgggtggggcaacgggtgcggcctgttcggcaaggggtccatcgtggcgtgcgccaagttcacgtgcgccaagagcatgagcctcttcgaggtcgaccagaccaagatccagtacgtgatccgcgcccagctgcacgtcggcgccaagcaggagaactggaacgcggacatcaagaccctgaagttcgacgccctctccgggagccaggaggccgagttcaccggctacgggaaggccaccctggagtgccaggtgcagacggccgtggacttctccaacagctacatcgcggagatggagaaggagtcctggatcgtcgaccggcagtgggcccaggacctgaccctcccctggcagagcggctccggcggggtgtggcgcgagatgcaccacctggtggagttcgagcccccgcacgccgccaccatcaaggtcctggcgctcggcaaccaggaggggagcctgaagaccgccctgacgggcgccatgcgggtgaccaaggacaccaacgggtccaacctctacaagctgcacggcggccacgtgagctgccgcgtcaagctgtccgccctcaccctgaaggggacgagctacaagatgtgcaccgacaagatgtccttcgtgaagaaccccaccgacaccggccacgggacggccgtgatgcaggtcaaggtgcccaagggcgcgccctgccggatcccggtgatggtcgccgacgacctgaccgccagcgtgaacaagggcatcctcgtgaccgtcaaccccatcgcctccaccaacgaggacgaggtgctgatcgaggtgaacccgcccttcggggacagctacatcatcgtcggcaccggggactcccgcctgacgtaccagtggcacaaggagggcagctccatcgggaagctgttcacccagaccatgaagggcgccgagcggctcgcggtgatgggcgacgccgcctgggacttcagcagcgccgggggcttcttcacctccgtggggaagggcatccacatggtcttcgggagcgccttccagggcctgttcggcgggctgtcctggatcacgaaggtgatcatgggcgcggtgctcatctgggtcgggatcaacatgcgcaacatgaccatgagcatgtccatgatcctggtgggcgtgatcatgatgttcctgagcctcggggtcggcgccgaccagggctgcgccatcaacttcgggcgg

SEQ ID NO: 644 - RNA, 2091 nt, synthetic construct
  misc_feature 1..2091: note = derived and/or modified CDS sequence (opt1) from YFV__JF912179__X-SS-prME-XX
  source 1..2091: mol_type = other RNA
atgcgcggcctgagctcccggaagcgccggagccaggacgccctcaccgtgcagttcctgatcctggggatgctcctgatggtcggcggggtgaccctggtgcgccggaaccgctggctcctgctgaacgtcacgtccgaggacctcggcaagaccttcagcgtggggaccggcaactgcaccacgaacatcctggaggccaagtactggtgccccgactccatggagtacaactgccccaacctgagcccccgggaggagcccgacgacatcgactgctggtgctacggcgtggagaacgtccgcgtggcgtacgggaagtgcgactccgccggccggagccgccggtcccgccgggccatcgacctccccacccacgagaaccacgggctgaagacccgccaggagaagtggatgaccggccggatgggggagcgccagctgcagaagatcgagcggtggctcgtgcgcaacccgttcttcgccgccacggcgctggccatcgcctacctggtcggcagcaacatgacccagcgggtggtgatcgccctcctggtcctggcggtgggccccgcctactccgcccactgcatcgggatcaccgaccgcgacttcatcgagggcgtgcacgggggcacctgggtcagcgccacgctcgagcaggacaagtgcgtgaccgtgatggcccccgacaagccctccctggacatcagcctggagaccgtcgcgatcgacggcccggccgaggcccggaaggtgtgctactccgccgtgctcaccaacgtcaagatcaacgacaagtgccccagcacgggggaggcccacctggaggaggagaacgagggcgacaacgcgtgcaagcgcacctactccgaccgcgggtggggcaacgggtgcggcctgttcggcaaggggagcatcgtggcctgcgccaagttcacgtgcgccaagtccatgagcctcttcgaggtggaccagaccaagatccagtacgtcatccgggcccagctgcacgtgggcgcgaagcaggagaactggaacaccgacatcaagaccctgaagttcgacgccctcagcgggtcccaggaggccgagttcaccggctacgggaaggccaccctggagtgccaggtccagacggccgtggacttcagcaactcctacatcgcggagatggagaaggagagctggatcgtggacaagcagtgggcccaggacctgaccctcccctggcagtccggcagcggcggggtctggcgcgagatgcaccacctggtggagttcgagcccccgcacgccgccaccatcaaggtgctggcgctcggcaaccaggaggggtccctgaagaccgccctgacgggcgccatgcgggtcaccaaggacaccaacaacagcaagctctacaagctgcacgggggccacgtggcctgccgcgtgaagctgtccgccctcaccctgaagggcacgagctacaagatgtgcaccgacaagatgtccttcgtcaagaaccccaccgacaccgggcacggcacggcggtgatgcaggtcaaggtgcccaagggggccccctgccggatcccggtgatggtggccgacgacctgaccgccgccgtcaacaagggcatcctcgtgaccgtgaaccccatcgcgagcaccaacgacgacgaggtcctgatcgaggtgaacccgcccttcggcgactcctacatcatcgtggggaccggcgacagccgcctgacgtaccagtggcacaaggaggggtccagcatcggcaagctgttcacccagaccatgaagggggccgagcggctcgccgtcatgggcgacgccgcctgggacttcggctccgccgggggcttcttcaccagcgtggggaagggcatccacacggtgttcgggtccgcgttccagggcctgttcggcgggctgagctggatcaccaaggtcatcatgggcgtggtgctcatctgggtcgggatcaacacccgcaacatgaccatgagcatgtccatgatcctggtgggcgtgatcatgatgttcctgagcctcggggtcggcgccgaccagggctgcgccatcaacttctccaag

SEQ ID NO: 645 - RNA, 2091 nt, synthetic construct
  misc_feature 1..2091: note = derived and/or modified CDS sequence (opt1) from YFV__JF912180__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgccggaaccgctggctcctgctgaacgtgacgtccgaggacctcggcaagaccttcagcgtggggaccggcaactgcaccacgaacatcctggaggccaagtactggtgccccgactccatggagtacaactgccccaacctgagcccccgggaggagcccgacgacatcgactgctggtgctacggcgtcgagaacgtgcgcgtggcctacgggaagtgcgactccgcgggccggagccgccggtcccgccgggccatcgacctccccacccacgagaaccacgggctgaagacccgccaggagaagtggatgaccggccggatgggggagcgccagctgcagaagatcgagcggtggctcgtccgcaacccgttcttcgccgccacggccctggcgatcgcctacctggtgggcagcaacatgacccagcgggtggtcatcgccctcctggtgctggccgtgggccccgcgtactccgcccactgcatcgggatcaccgaccgcgacttcatcgagggcgtccacgggggcacctgggtgagcgccacgctcgagcaggacaagtgcgtgaccgtcatggcccccgacaagccctccctggacatcagcctggagaccgtggccatcgacggcccggcggaggcccggaaggtgtgctactccgccgtcctcaccaacgtgaagatcaacgacaagtgccccagcacgggggaggcccacctggaggaggagaacgagggcgacaacgcctgcaagcgcacctactccgaccgcgggtggggcaacgggtgcggcctgttcggcaaggggagcatcgtggcgtgcgccaagttcacgtgcgccaagtccatgagcctcttcgaggtcgaccagaccaagatccagtacgtgatccgggcccagctgcacgtcggcgccaagcaggagaactggaacaccgacatcaagaccctgaagttcgacgcgctcagcgggtcccaggaggccgagttcaccggctacgggaaggccaccctggagtgccaggtgcagacggccgtggacttcagcaactcctacatcgccgagatggagaaggagagctggatcgtcgacaagcagtgggcgcaggacctgaccctcccctggcagtccggcagcggcggggtgtggcgcgagatgcaccacctggtggagttcgagcccccgcacgccgccaccatcaaggtcctggccctcggcaaccaggaggggtccctgaagaccgcgctgacgggcgccatgcgggtgaccaaggacaccaacaacagcaagctctacaagctgcacgggggccacgtgtcctgccgcgtcaagctgagcgccctcaccctgaagggcacgtcctacaagatgtgcaccgacaagatgagcttcgtgaagaaccccaccgacaccgggcacggcacggccgtgatgcaggtcaaggtgcccaagggggccccctgccggatcccggtgatggtcgcggacgacctgaccgccgccgtgaacaagggcatcctcgtgaccgtcaaccccatcgcctccaccaacgacgacgaggtgctgatcgaggtgaacccgcccttcggcgacagctacatcatcgtcgggaccggcgactcccgcctgacgtaccagtggcacaaggaggggagctccatcggcaagctgttcacccagaccatgaagggggccgagcggctcgcggtgatgggcgacgccgcctgggacttcggcagcgccgggggcttcttcacctccgtggggaagggcatccacacggtcttcgggagcgccttccagggcctgttcggcgggctgagctggatcaccaaggtgatcatgggcgtggtcctcatctgggtggggatcaacacccgcaacatgaccatgtccatgagcatgatcctggtgggcgtcatcatgatgttcctgtccctcggggtgggcgcggaccagggctgcgccatcaacttcgggaag

SEQ ID NO: 646 - RNA, 2091 nt, synthetic construct
  misc_feature 1..2091: note = derived and/or modified CDS sequence (opt1) from YFV__JF912181__X-SS-prME-XX
  source 1..2091: mol_type = other RNA
atgcgcggcctgagctcccggaagcgccggagccacgaggtgctcaccgtccacttcctgatcctggggatgatgctcatgaccggcggggtgacgctggtgcgcaagtcccggtggctgctcctgaacgtcaccagcgaggacctgggcaagaccttctccgtggggaccggcaactgcacgaccaacatcctcgacgccaagaactggtgccccgacagcatggagtacaactgccccaacctgagcccccgcgaggagcccgacgacatcgactgctggtgctacggcgtggagaacgtccgggtggcctacgggaagtgcgactccgcgggccgctcccggcgcagccggcgcgccatcgacctgcccacccacgagaaccacgggctcaagacccggcaggagaagtggatgacgggccgcatgggggagcggcagctgcagaagatcgagcgctggctggtgcggaacccgttcttcgccgtcaccgccctcgccatcgcgtacctggtgggctccaacatgacccagcgcgtggtcatcgccctgctcgtgctggccgtgggccccgcctacagcgcgcactgcatcgggatcaccgaccgggacttcatcgagggcgtccacgggggcacgtgggtgtccgccaccctggagcaggacaagtgcgtgaccgtcatggcccccgacaagcccagcctcgacatctccctggagaccgtggccatcgacggcccggccgaggcgcgcaaggtgtgctacagcgccgtcctgacgcacgtgaagatcaacgacaagtgcccctccaccggggaggcccacctcgccgaggagaacgagggcgacaacgcctgcaagcggacctacagcgaccgcgggtggggcaacgggtgcggcctgttcggcaaggggtccatcgtggcgtgcgccaagttcacgtgcgccaagagcatgagcctgttcgaggtcgaccagaccaagatccagtacgtgatccgcgcccagctccacgtcggcgccaagcaggagaactggaacgcggacatcaagaccctgaagttcgacgccctgtccgggagccaggaggccgagttcaccggctacgggaaggccaccctcgagtgccaggtgcagacggccgtggacttctccaacagctacatcgcggagatggagaaggagtcctggatcgtcgaccggcagtgggcccaggacctgaccctgccctggcagagcggctccggcggggtgtggcgcgagatgcaccacctcgtggagttcgagcccccgcacgccgccaccatcaaggtcctggcgctgggcaaccaggaggggagcctcaagaccgccctgacgggcgccatgcgggtgaccaaggacgccaacgggtccaacctgtacaagctccacggcggccacgtgagctgccgcgtcaagctgtccgccctgaccctcaaggggaccagctacaagatgtgcacggacaagatgtccttcgtgaagaaccccaccgacaccggccacgggaccgcggtgatgcaggtcaaggtgcccaagggcgccccctgccggatcccggtgatggtcgccgacgacctgacggccgccgtgaacaagggcatcctggtgaccgtcaaccccatcgcgagcaccaacgaggacgaggtgctcatcgaggtgaacccgcccttcggggactcctacatcatcgtcggcaccggggacagccgcctgacctaccagtggcacaaggagggctccagcatcgggaagctgttcacgcagaccatgaagggcgccgagcggctcgccgtgatgggcgacgccgcctgggacttctccagcgccgggggcttcttcaccagcgtggggaagggcatccacatggtcttcgggtccgcgttccagggcctgttcggcgggctgagctggatcaccaaggtgatcatcggcgccgtgctgatctgggtcgggatcaacatgcgcaacatgacgatgtccatgggcatgatcctcgtgggggtgatcatgatgttcctgagcctgggcgtcggcgccgaccaggggtgcgcgatcaacttcggcaag

SEQ ID NO: 647 - RNA, 2091 nt, synthetic construct
  misc_feature 1..2091: note = derived and/or modified CDS sequence (opt1) from YFV__JF912182__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgcaagaaccggtggctcctgctgaacgtgacgtccgaggacctcggcaagaccttcagcgtggggaccggcaactgcaccacgaacatcctggaggccaagtactggtgccccgactccatggagtacaactgccccaacctgagcccccgcgaggagcccgacgacatcgactgctggtgctacggcgtcgagaacgtgcgggtggcctacgggaagtgcgactccgcgggccgcagccggcgctcccggcgcgccatcgacctccccacccacgagaaccacgggctgaagacccggcaggagaagtggatgaccggccgcatgggggagcggcagctgcagaagatcgagcgctggctcgtccggaacccgttcttcgccgccacggccctggcgatcgcctacctggtgggcagcaacatgacccagcgcgtggtcatcgccctcctggtgctggccgtgggccccgcgtactccgcccactgcatcgggatcaccgaccgggacttcatcgagggcgtccacgggggcacctgggtgagcgccacgctcgagcaggacaagtgcgtgaccgtcatggcccccgacaagccctccctggacatcagcctggagaccgtggccatcgacggcccggcggaggcccgcaaggtgtgctactccgccgtcctcaccaacgtgaagatcaacgacaagtgccccagcacgggggaggcccacctggaggaggagaacgagggcgacaacgcctgcaagcggacctactccgaccgcgggtggggcaacgggtgcggcctgttcggcaaggggagcatcgtggcgtgcgccaagttcgcctgcgccaagtccatgagcctcttcgaggtcgaccagaccaagatccagtacgtgatccgcgcccagctgcacgtcggcgcgaagcaggagaactggaacaccgacatcaagacgctgaagttcgacgccctcagcgggtcccaggaggccgagttcaccggctacgggcgggccaccctggagtgccaggtgcagaccgccgtggacttcagcaactcctacatcgcggagatggagaaggagagctggatcgtcgacaagcagtgggcccaggacctgacgctcccctggcagtccggcagcggcggggtgtggcgcgagatgcaccacctggtggagttcgagcccccgcacgccgccaccatcaaggtcctggcgctcggcaaccaggaggggtccctgaagaccgccctgaccggcgccatgcgggtgacgaaggacaccaacaacagcaagctctacaagctgcacgggggccacgtggcctgccgcgtcaagctgtccgccctcaccctgaagggcaccagctacaagatgtgcacggacaagatgtccttcgtgaagaaccccaccgacaccgggcacggcaccgcggtgatgcaggtcaaggtgcccaagggggccccctgccggatcccggtgatggtcgccgacgacctgacggccgccgtgaacaagggcatcctcgtgaccgtcaaccccatcgcgagcaccaacgacgacgaggtgctgatcgaggtgaacccgcccttcggcgactcctacatcatcgtcgggaccggcgacagccgcctgacctaccagtggcacaaggaggggtccagcatcggcaagctgttcacgcagaccatgaagggggccgagcggctcgccgtgatgggcgacgccgcctgggacttcggctccgccgggggcttcttcaccagcgtggggaagggcatccacaccgtcttcgggtccgcgttccagggcctgttcggcgggctgagctggatcacgaaggtgatcatgggcgtggtcctcatctgggtggggatcaacacccgcaacatgaccatgagcatgtccatgatcctggtgggcgtcatcatgatgttcctgagcctcggggtgggcgccgaccagggctgcgccatcaacttcgggaag

SEQ ID NO: 648 - RNA, 2091 nt, synthetic construct
  misc_feature 1..2091: note = derived and/or modified CDS sequence (opt1) from YFV__JF912183__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgccggaaccgctggctcctgctgaacgtgacgtccgaggacctcggcaagaccttcagcgtggggaccggcaactgcaccacgaacatcctggaggccaagtactggtgccccgactccatggagtacaactgccccaacctgagcccccgggaggagcccgacgacatcgactgctggtgctacggcgtcgagaacgtgcgcgtggcctacgggaagtgcgactccgcgggccggagccgccggtcccgccgggccatcgacctccccacccacgagaaccacgggctgaagacccgccaggagaagtggatgaccggccggatgggggagcgccagctgcagaagatcgagcggtggctcgtccgcaacccgttcttcgccgccacggccctggcgatcgcctacctggtgggcagcaacatgacccagcgggtggtcatcgccctcctggtgctggccgtgggccccgcgtactccgcccactgcatcgggatcaccgaccgcgacttcatcgagggcgtccacgggggcacctgggtgagcgccacgctcgagcaggacaagtgcgtgaccgtcatggcccccgacaagccctccctggacatcagcctggagaccgtggccatcgacggcccggcggaggcccggaaggtgtgctactccgccgtcctcaccaacgtgaagatcaacgacaagtgccccagcacgggggaggcccacctggaggaggagaacgagggcgacaacgcctgcaagcgcacctactccgaccgcgggtggggcaacgggtgcggcctgttcggcaaggggagcatcgtggcgtgcgccaagttcacgtgcgccaagtccatgagcctcttcgaggtcgaccagaccaagatccagtacgtgatccgggcccagctgcacgtcggcgccaagcaggagaactggaacaccgacatcaagaccctgaagttcgacgcgctcagcgggtcccaggaggccgagttcaccggctacgggaaggccaccctggagtgccaggtgcagacggccgtggacttcagcaactcctacatcgccgagatggagaaggagagctggatcgtcgacaagcagtgggcgcaggacctgaccctcccctggcagtccggcagcggcggggtgtggcgcgagatgcaccacctggtggagttcgagcccccgcacgccgccaccatcaaggtcctggccctcggcaaccaggaggggtccctgaagaccgcgctgacgggcgccatgcgggtgaccaaggacaccaacaacagcaagctctacaagctgcacgggggccacgtggcctgccgcgtcaagctgtccgccctcaccctgaagggcacgagctacaagatgtgcaccgacaagatgtccttcgtgaagaaccccaccgacaccgggcacggcacggccgtgatgcaggtcaaggtgcccaagggggcgccctgccggatcccggtgatggtcgccgacgacctgaccgccgccgtgaacaagggcatcctcgtgaccgtcaaccccatcgccagcaccaacgacgacgaggtgctgatcgaggtgaacccgcccttcggcgactcctacatcatcgtcgggaccggcgacagccgcctgacgtaccagtggcacaaggaggggtccagcatcggcaagctgttcacccagaccatgaagggggcggagcggctcgccgtgatgggcgacgccgcctgggacttcggctccgccgggggcttcttcaccagcgtggggaagggcatccacacggtcttcgggtccgcgttccagggcctgttcggcgggctgagctggatcaccaaggtgatcatgggcgtggtcctcatctgggtggggatcaacacccgcaacatgaccatgagcatgtccatgatcctggtgggcgtcatcatgatgttcctgagcctcggggtgggcgccgaccagggctgcgccatcaacttcgggaag

SEQ ID NO: 649 - RNA, 2091 nt, synthetic construct
  misc_feature 1..2091: note = derived and/or modified CDS sequence (opt1) from YFV__JF912184__X-SS-prME-XX
  source 1..2091: mol_type = other RNA
atgcgcggcctgagctcccggaagcgccggagccaggacgccctcaccgtgcagttcctgatcctggggatgctcctgatggtcggcggggtgaccctggtgcgccggaaccgctggctcctgctgaacgtcacgtccgaggacctcggcaagaccttcagcgtggggaccggcaactgcaccacgaacatcctggaggccaagtactggtgccccgactccatggagtacaactgccccaacctgagcccccgggaggagcccgacgacatcgactgctggtgctacggcgtggagaacgtccgcgtggcgtacgggaagtgcgactccgccggccggagccgccggtcccgccgggccatcgacctccccacccacgagaaccacgggctgaagacccgccaggagaagtggatgaccggccggatgggggagcgccagctgcagaagatcgagcggtggctcgtgcgcaacccgttcttcgccgccacggcgctggccatcgcctacctggtcggcagcaacatgacccagcgggtggtgatcgccctcctggtcctggcggtgggccccgcctactccgcccactgcatcgggatcaccgaccgcgacttcatcgagggcgtgcacgggggcacctgggtcagcgccacgctcgagcaggacaagtgcgtgaccgtgatggcccccgacaagccctccctggacatcagcctggagaccgtcgcgatcgacggcccggccgaggcccggaaggtgtgctactccgccgtgctcaccaacgtcaagatcaacgacaagtgccccagcacgggggaggcccacctggaggaggagaacgagggcgacaacgcgtgcaagcgcacctactccgaccgcgggtggggcaacgggtgcggcctgttcggcaaggggagcatcgtggcctgcgccaagttcacgtgcgccaagtccatgagcctcttcgaggtggaccagaccaagatccagtacgtcatccgggcccagctgcacgtgggcgcgaagcaggagaactggaacaccgacatcaagaccctgaagttcgacgccctcagcgggtcccaggaggccgagttcaccggctacgggaaggccaccctggagtgccaggtccagacggccgtggacttcagcaactcctacatcgcggagcgcgagaaggagagctggatcgtggacaagcagtgggcccaggacctgaccctcccctggcagtccggcagcggcggggtctggcgggagatgcaccacctggtggagttcgagcccccgcacgccgccaccatcaaggtgctggcgctcggcaaccaggaggggtccctgaagaccgccctgacgggcgccatgcgcgtcaccaaggacaccaacaacagcaagctctacaagctgcacgggggccacgtggcctgccgggtgaagctgtccgccctcaccctgaagggcacgagctacaagatgtgcaccgacaagatgtccttcgtcaagaaccccaccgacaccgggcacggcacggcggtgatgcaggtcaaggtgcccaagggggccccctgccgcatcccggtgatggtggccgacgacctgaccgccgccgtcaacaagggcatcctcgtgaccgtgaaccccatcgcgagcaccaacgacgacgaggtcctgatcgaggtgaacccgcccttcggcgactcctacatcatcgtggggaccggcgacagccggctgacgtaccagtggcacaaggaggggtccagcatcggcaagctgttcacccagaccatgaagggggccgagcgcctcgccgtcatgggcgacgccgcctgggacttcggctccgccgggggcttcttcaccagcgtggggaagggcatccacacggtgttcgggtccgcgttccagggcctgttcggcgggctgagctggatcaccaaggtcatcatgggcgtggtgctcatctgggtcgggatcaacacccggaacatgaccatgagcatgtccatgatcctggtgggcgtgatcatgatgttcctgagcctcggggtcggcgccgaccagggctgcgccatcaacttcgggaag

SEQ ID NO: 650 - RNA, 2091 nt, synthetic construct
  misc_feature 1..2091: note = derived and/or modified CDS sequence (opt1) from YFV__JF912185__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgcaagaaccggtggctcctgctgaacgtgacgtccgaggacctcggcaagaccttcagcgtggggaccggcaactgcaccacgaacatcctggaggccaagtactggtgccccgactccatggagtacaactgccccaacctgagcccccgcgaggagcccgacgacatcgactgctggtgctacggcgtcgagaacgtgcgggtggcctacgggaagtgcgactccgcgggccgcagccggcgctcccggcgcgccatcgacctccccacccacgagaaccacgggctgaagacccggcaggagaagtggatgaccggccgcatgggggagcggcagctgcagaagatcgagcgctggctcgtccggaacccgttcttcgccgccacggccctggcgatcgcctacctggtgggcagcaacatgacccagcgcgtggtcatcgccctcctggtgctggccgtgggccccgcgtactccgcccactgcatcgggatcaccgaccgggacttcatcgagggcgtccacgggggcacctgggtgagcgccacgctcgagcaggacaagtgcgtgaccgtcatggcccccgacaagccctccctggacatcagcctggagaccgtggccatcgacggcccggcggaggcccgcaaggtgtgctactccgccgtcctcaccaacgtgaagatcaacgacaagtgccccagcacgggggaggcccacctggaggaggagaacgagggcgacaacgcctgcaagcggacctactccgaccgcgggtggggcaacgggtgcggcctgttcggcaaggggagcatcgtggcgtgcgccaagttcacgtgcgccaagtccatgagcctcttcgaggtcgaccagaccaagatccagtacgtgatccgcgcccagctgcacgtcggcgccaagcaggagaactggaacaccgacatcaagaccctgaagttcgacgcgctcagcgggtcccaggaggccgagttcaccggctacgggcgggccaccctggagtgccaggtgcagacggccgtggacttcagcaactcctacatcgccgagatggagaaggagagctggatcgtcgacaagcagtgggcgcaggacctgaccctcccctggcagtccggcagcggcggggtgtggcgcgagatgcaccacctggtggagttcgagcccccgcacgccgccaccatcaaggtcctggccctcggcaaccaggaggggtccctgaagaccgcgctgacgggcgccatgcgggtgaccaaggacaccaacaacagcaagctctacaagctgcacgggggccacgtggcctgccgcgtcaagctgtccgccctcaccctgaagggcacgagctacaagatgtgcaccgacaagatgtccttcgtgaagaaccccaccgacaccgggcacggcacggccgtgatgcaggtcaaggtgcccaagggggcgccctgccggatcccggtgatggtcgccgacgacctgaccgccgccgtgaacaagggcatcctcgtgaccgtcaaccccatcgccagcaccaacgacgacgaggtgctgatcgaggtgaacccgcccttcggcgactcctacatcatcgtcgggaccggcgacagccgcctgacgtaccagtggcacaaggaggggtccagcatcggcaagctgttcacccagaccatgaagggggcggagcggctcgccgtgatgggcgacgccgcctgggacttcggctccgccgggggcttcttcaccagcgtggggaagggcatccacacggtcttcgggtccgcgttccagggcctgttcggcgggctgagctggatcaccaaggtgatcatgggcgtggtcctcatctgggtggggatcaacacccgcaacatgaccatgagcatgtccatgatcctggtgggcgtcatcatgatgttcctgagcctcggggtgggcgccgaccagggctgcgccatcaacttcgggaag

SEQ ID NO: 651 - RNA, 2091 nt, synthetic construct
  misc_feature 1..2091: note = derived and/or modified CDS sequence (opt1) from YFV__JF912186__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgccggtcccgctggctcctgctgaacgtgacgagcgaggacctcggcaagaccttctccgtggggaccggcaactgcaccacgaacatcctggaggccaagtactggtgccccgacagcatggagtacaactgccccaacctgagcccccgggaggagcccgacgacatcgactgctggtgctacggcgtcgagaacgtgcgcgtggcctacgggaagtgcgactccgcgggccggtcccgccggagccgccgggccatcgacctccccacccacgagaaccacgggctgaagacccgccaggagaagtggatgaccggccggatgggggagcgccagctgcagaagatcgagcggtggctcgtccgcaacccgttcttcgccgccacggccctggcgatcgcctacctggtgggctccaacatgacccagcgggtggtcatcgccctcctggtgctggccgtgggccccgcgtacagcgcccactgcatcgggatcaccgaccgcgacttcatcgagggcgtccacgggggcacctgggtgtccgccacgctcgagcaggacaagtgcgtgaccgtcatggcccccgacaagcccagcctggacatctccctggagaccgtggccatcgacggcccggcggaggcccggaaggtgtgctacagcgccgtcctcaccaacgtgaagatcaacgacaagtgcccctccacgggggaggcccacctggaggaggagaacgagggcgacaacgcctgcaagcgcacctacagcgaccgcgggtggggcaacgggtgcggcctgttcggcaaggggtccatcgtggcgtgcgccaagttcacgtgcgccaagagcatgagcctcttcgaggtcgaccagaccaagatccagtacgtgatccgggcccagctgcacgtcggcgccaagcaggagaactggaacaccgacatcaagaccctgaagttcgacgcgctctccgggagccaggaggccgagttcaccggctacgggaaggccaccctggagtgccaggtgcagacggccgtggacttctccaacagctacatcgccgagatggagaaggagtcctggatcgtcgacaagcagtgggcgcaggacctgaccctcccctggcagagcggctccggcggggtgtggcgcgagatgcaccacctggtggagttcgagcccccgcacgccgccaccatcaaggtcctggccctcggcaaccaggaggggagcctgaagaccgcgctgacgggcgccatgcgggtgaccaaggacaccaacaactccaagctctacaagctgcacgggggccacgtggcctgccgcgtcaagctgagcgccctcaccctgaagggcacgtcctacaagatgtgcaccgacaagatgagcttcgtgaagaaccccaccgacaccgggcacggcacggccgtgatgcaggtcaaggtgcccaagggggcgccctgccggatcccggtgatggtcgccgacgacctgaccgccgccgtgaacaagggcatcctcgtgaccgtcaaccccatcgcctccaccaacgacgacgaggtgctgatcgaggtgaacccgcccttcggcgacagctacatcatcgtcgggaccggcgactcccgcctgacgtaccagtggcacaaggaggggagctccatcggcaagctgttcacccagaccatgaagggggcggagcggctcgccgtgatgggcgacgccgcctgggacttcggcagcgccgggggcttcttcacctccgtggggaagggcatccacacggtcttcgggagcgcgttccagggcctgttcggcgggctgagctggatcaccaaggtgatcatgggcgtggtcctcatctgggtggggatcaacacccgcaacatgaccatgtccatgagcatgatcctggtgggcgtcatcatgatgttcctgtccctcggggtgggcgccgaccagggctgcgccatcaacttcgggaag

SEQ ID NO: 652 - RNA, 2091 nt, synthetic construct
  misc_feature 1..2091: note = derived and/or modified CDS sequence (opt1) from YFV__JF912187__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgccggaaccgctggctcctgctgaacgtgacgtccgaggacctcggcaagaccttcagcgtggggaccggcaactgcaccacgaacatcctggaggccaagtactggtgctccgacagcatggagtacaactgccccaacctgagcccccgggaggagcccgacgacatcgactgctggtgctacggcgtcgagaacgtgcgcgtggcctacgggaagtgcgactccgcgggccggtcccgccggagccgccgggccatcgacctccccacccacgagaaccacgggctgaagacccgccaggagaagtggatgaccggccggatgggggagcgccagctgcagaagatcgagcggtggctcgtccgcaaccccttcttcgccgccacggccctggcgatcgcctacctggtgggctccaacatgacccagcgggtggtcatcgccctcctggtgctggccgtgggcccggcgtacagcgcccactgcatcgggatcaccgaccgcgacttcatcgagggcgtccacgggggcacctgggtgtccgccacgctcgagcaggacaagtgcgtgaccgtcatggcccccgacaagcccagcctggacatctccctggagaccgtggccatcgacggccccgcggaggcccggaaggtgtgctacagcgccgtcctcaccaacgtgaagatcaacgacaagtgcccgtccacgggggaggcccacctggaggaggagaacgagggcgacaacgcctgcaagcgcacctacagcgaccgcgggtggggcaacgggtgcggcctgttcggcaaggggtccatcgtggcgtgcgccaagttcacgtgcgccaagagcatgagcctcttcgaggtcgaccagaccaagatccagtacgtgatccgggcccagctgcacgtcggcgccaagcaggagaactggaacaccgacatcaagaccctgaagttcgacgcgctctccgggagccaggaggccgagttcaccggctacgggcgcgccaccctggagtgccaggtgcagacggccgtggacttctccaacagctacatcgccgagatggagaaggagtcctggatcgtcgacaagcagtgggcgcaggacctgaccctcccctggcagagcggctccggcggggtgtggcgggagatgcaccacctggtggagttcgagccgccccacgccgccaccatcaaggtcctggccctcggcaaccaggaggggagcctgaagaccgcgctgacgggcgccatgcgcgtgaccaaggacaccaacaactccaagctctacaagctgcacgggggccacgtggcctgccgggtcaagctgagcgccctcaccctgaagggcacgtcctacaagatgtgcaccgacaagatgagcttcgtgaagaaccccaccgacaccgggcacggcacggccgtgatgcaggtcaaggtgcccaagggggcgccctgccgcatccccgtgatggtcgccgacgacctgaccgccgccgtgaacaagggcatcctcgtgaccgtcaacccgatcgcctccaccaacgacgacgaggtgctgatcgaggtgaacccgcccttcggcgacagctacatcatcgtcgggaccggcgactcccggctgacgtaccagtggcacaaggaggggagctccatcggcaagctgttcacccagaccatgaagggggcggagcgcctcgccgtgatgggcgacgccgcctgggacttcggcagcgccgggggcttcttcacctccgtggggaagggcatccacacggtcttcgggagcgcgttccagggcctgttcggcgggctgagctggatcaccaaggtgatcatgggcgtggtcctcatctgggtggggatcaacacccggaacatgaccatgtccatgagcatgatcctggtgggcgtcatcatgatgttcctgtccctcggggtgggcgccgaccagggctgcgccatcaacttcgggaag

SEQ ID NO: 653 - RNA, 2091 nt, synthetic construct
  misc_feature 1..2091: note = derived and/or modified CDS sequence (opt1) from YFV__JF912189__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgccggaaccgctggctcctgctgaacgtgacgtccgaggacctcggcaagaccttcagcgtggggaccggcaactgcaccacgaacatcctggaggccaagtactggtgccccgactccatggagtacaactgccccaacctgagcccccgggaggagcccgacgacatcgactgctggtgctacggcgtcgagaacgtgcgcgtggcctacgggaagtgcgactccgcgggccggagccgccggtcccgccgggccatcgacctccccacccacgagaaccacgggctgaagacccgccaggagaagtggatgaccggccggatgggggagcgccagctgcagaagatcgagcggtggctcgtccgcaacccgttcttcgccgccacggccctggcgatcgcctacctggtgggcagcaacatgacccagcgggtggtcatcgccctcctggtgctggccgtgggccccgcgtactccgcccactgcatcgggatcaccgaccgcgacttcatcgagggcgtccacgggggcacctgggtgagcgccacgctcgagcaggacaagtgcgtgaccgtcatggcccccgacaagccctccctggacatcagcctggagaccgtggccatcgacggcccggcggaggcccggaaggtgtgctactccgccgtcctcaccaacgtgaagatcaacgacaagtgccccagcacgggggaggcccacctggaggaggagaacgagggcgacaacgcctgcaagcgcacctactccgaccgcgggtggggcaacgggtgcggcctgttcggcaaggggagcatcgtggcgtgcgccaagttcacgtgcgccaagtccatgagcctcttcgaggtcgaccagaccaagatccagtacgtgatccgggcccagctgcacgtcggcgtgaagcaggagaactggaacaccgacatcaagaccctgaagttcgacgccctcagcgggtcccaggaggcggagttcaccggctacgggcgcgccaccctggagtgccaggtgcagacggccgtcgacttcagcaactcctacatcgccgagatggagaaggagagctggatcgtggacaagcagtgggcccaggacctgaccctcccctggcagtccggcagcggcggggtgtggcgggagatgcaccacctggtcgagttcgagcccccgcacgcggccaccatcaaggtgctggccctcggcaaccaggaggggtccctgaagaccgccctgacgggcgcgatgcgcgtgaccaaggacaccaacaacagcaagctctacaagctgcacgggggccacgtcgcctgccgggtgaagctgtccgccctcaccctgaagggcacgagctacaagatgtgcaccgacaagatgtccttcgtgaagaaccccaccgacaccgggcacggcacggccgtcatgcaggtcaaggtgcccaagggggccccctgccgcatcccggtgatggtggcggacgacctgaccgccgccgtgaacaagggcatcctcgtcaccgtgaaccccatcgccagcaccaacgacgacgaggtgctgatcgaggtcaacccgcccttcggcgactcctacatcatcgtggggaccggcgacagccggctgacgtaccagtggcacaaggaggggtccagcatcggcaagctgttcacccagaccatgaagggggccgagcgcctcgcggtgatgggcgacgccgcctgggacttcggctccgccgggggcttcttcaccagcgtcgggaagggcatccacacggtgttcgggtccgccttccagggcctgttcggcgggctgagctggatcaccaaggtgatcatgggcgtcgtgctcatctgggtggggatcaacacccggaacatgaccatgagcatgtccatgatcctggtcggcgtgatcatgatgttcctgagcctcggggtgggcgcggaccagggctgcgccatcaacttcgggaag

SEQ ID NO: 654 - RNA, 2061 nt, synthetic construct
  misc_feature 1..2061: note = derived and/or modified CDS sequence (opt1) from YFV__AH005112__X-SS-prME-XX
  source 1..2061: mol_type = other RNA
atgcgcggcctgagctcccggaagcgccggagccacgacgtgctcaccgtccagttcctgatcctggggatgctcctgatggccggcggggtgaccctggtgcgcaagaaccggtggctcctgctgaacgtcacgtccgaggacctcggcaagaccttcagcgtggggaccggcaactgcaccacgaacatcctggaggccaagtactggtgccccgactccatggagtacaactgccccaacctgagcccccgcgaggagcccgacgacatcgactgctggtgctacggcgtggagaacgtccgggtggcgtacgggaagtgcgactccgccggccgcagccggcgctcccggcgcgccatcgacctccccacccacgagaaccacgggctgaagacccggcaggagaagtggatgaccggccgcatgggggagcggcagctgcagaagatcgagcgctggctcgtgcggaacccgttcttcgccgtcacggccctgaccatcgcgtacctggtgggcagcaacatgacccagcgcgtggtcatcgccctcctggtgctggccgtgggccccgcctactccgcgcactgcatcgggatcaccgaccgggacttcatcgagggcgtccacgggggcacgtgggtgagcgccaccctcgagcaggacaagtgcgtgaccgtcatggcccccgacaagccctccctggacatcagcctggagaccgtggccatcgacggcccggccgaggcgcgcaaggtgtgctacaacgccgtcctcacgcacgtgaagatcaacgacaagtgcccctccaccggggaggcccacctggccgaggagaacgagggcgacaacgcctgcaagcggacctacagcgaccgcgggtggggcaacgggtgcggcctgttcggcaaggggtccatcgtggcgtgcgccaagttcacgtgcgccaagaccatgagcctcttcgaggtcgaccagaccaagatccagtacgtgatccgcgcccagctgcacgtcggcgccaagcaggagaactggaacaccgacatcaagaccctgaagttcgacgcgctctccgggagccaggaggccgagttcacgggctacgggaaggccaccctggagtgccaggtgcagaccgccgtggacttcggcaacagctacatcgccgagatggagaaggagtcctggatcgtcgaccggcagtgggcgcaggacctgaccctcccctggcagagcggctccgggggcgtgtggcgcgagatgcaccacctggtggagttcgagcccccgcacgccgccacgatccgggtcctggccctcgggaaccaggagggcagcctgaagaccgcgctgaccggggccatgcgcgtgaccaaggacacgaacgacaacaacctctacaagctgcacggcggccacgtgtcctgccgggtcaagctgagcgccctcaccctgaaggggacctcctacaagatgtgcaccgacaagatgagcttcgtgaagaaccccacggacaccggccacgggaccgtggtcatgcaggtcaaggtgcccaagggcgccccctgcaagatcccggtgatcgtggccgacgacctgaccgcggccatcaacaagggcatcctcgtgaccgtcaaccccatcgcctccacgaacgacgacgaggtgctgatcgaggtgaacccgcccttcggggacagctacatcatcgtcggcaccggggactcccgcctgacctaccagtggcacaaggagggcagctccatcgggaagctgttcacccagacgatgcggggccaggagcgcctcgccgtgatgggcgacaccgcctgggacttcagctccgccgggggcttcttcaccagcatcgggaagggcatccacaccgtgttcgggtccgcgttccagggcctgttcggcgggctgagctggatcacgaaggtcatcatgggcgccgtgctcatctgggtggggatcaacacccggaacatgaccatgtccatgagcatgatcctggtcggcgtgatcatgatgttcctgagcctcggggtgggcgcc

SEQ ID NO: 655 - RNA, 2091 nt, synthetic construct
  misc_feature 1..2091: note = derived and/or modified CDS sequence (opt1) from YFV__FJ654700__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaacaccgacatcaagaccctgaagttcgacgccctgagcggcagccaggaggtggagttcacggggtacggcaaggccaccctcgagtgccaggtccagaccgcggtggacttcgggaactcctacatcgccgagatggagaccgagagctggatcgtggaccgccagtgggcccaggacctgacgctgccctggcagtccggcagcggcggggtctggcgggagatgcaccacctcgtggagttcgagcccccgcacgccgtgaccatccgcgtcctggccctgggcaaccaggaggggtccctcaagaccgcgctgaccggcgccatgcgggtgacgaaggacaccaacgacaacaacctgtacaagctccacgggggccacgtgagctgccgcgtcaagctgtccgccctgaccctcaagggcaccagctacaagatctgcacggacaagatgttcttcgtgaagaaccccaccgacaccgggcacggcaccgtggtcatgcaggtcaaggtgtccaagggggccccctgccggatccccgtgatcgtggcggacgacctgaccgccgccatcaacaagggcatcctggtgacggtcaacccgatcgccagcaccaacgacgacgaggtgctcatcgaggtgaacccgcccttcggcgactcctacatcatcgtcgggcgcggcgacagccggctgacctaccagtggcacaaggaggggtccagcatcggcaagctgttcacccagacgatgaagggggtggagcgcctcgccgtgatgggcgacaccgcgtgggacttctccagcgccggcgggttcttcacctccgtcggcaaggggatccacaccgtgttcggcagcgccttccaggggctgttcggcggcctgaactggatcacgaaggtgatcatgggggccgtcctgatctgggtgggcatcaacacccggaacatgaccatgtccatgagcatgatcctcgtgggggtcatcatgatgttcctgagcctgggcgtgggggccgaccagggctgcgcgatcaacttcggcaag

SEQ ID NO: 656 - RNA, 2091 nt, synthetic construct
  misc_feature 1..2091: note = derived and/or modified CDS sequence (opt1) from YFV__KM388817__X-SS-prME-XX
  source 1..2091: mol_type = other RNA
atgcgcggcctgagctcccggaagcgccggagccaggacgtgctcaccgtccagttcctgatcctggggatgctcctgatggccggcggggtgaccctggtgcgccggaaccgctggctcctgctgaacgtcacgtccgaggacctcggcaagaccttcagcgtggggaccggcaactgcaccacgaacatcctggaggccaagtactggtgccccgactccatggagtacaactgccccaacctgagcccccgggaggagcccgacgacatcgactgctggtgctacggcgtggagaacgtccgcgtggcgtacgggaagtgcgactccgccggccggagccgccggtcccgccgggccatcgacctccccacccacgagaaccacgggctgaagacccgccaggagaagtggatgaccggccggatgggggagcgccagctgcagaagatcgagcggtggctcgtgcgcaacccgttcttcgccgccacggcgctgaccatcgcctacctggtcggcagcaacatgacccagcgggtggtgatcgccctcctggtcctggccgtgggccccgcgtactccgcccactgcatcgggatcaccgaccgcgacttcatcgagggcgtgcacgggggcacgtgggtcagcgccaccctcgagcaggacaagtgcgtgaccgtgatggcccccgacaagccctccctggacatcagcctggagaccgtcgccatcgacggcccggcggaggcccggaaggtgtgctactccgccgtgctcacgaacgtcaagatcaacgacaagtgccccagcaccggggaggcccacctggaggaggagaacgagggcgacaacgcctgcaagcgcacctactccgaccgcgggtggggcaacgggtgcggcctgttcggcaaggggagcatcgtggcgtgcgccaagttcacgtgcgccaagtccatgagcctcttcgaggtggaccagaccaagatccagtacgtcatccgggcccagctgcacgtgggcgccaagcaggagaactggaacaccgacatcaagaccctgaagttcgacgcgctcagcgggtcccaggaggccgagttcaccggctacgggcgcgccacgctggagtgccaggtccagaccgccgtggacttcagcaactcctacatcgccgagatggagaaggagagctggatcgtggacaagcagtgggcgcaggacctgaccctcccctggcagtccggcagcggcggggtctggcgggagatgcaccacctggtggagttcgagcccccgcacgccgccaccatcaaggtgctggccctcggcaaccaggaggggtccctgaagacggcgctgaccggcgccatgcgcgtcaccaaggacaccaacaacagcaagctctacaagctgcacgggggccacgtggcctgccgggtgaagctgtccgccctcacgctgaagggcaccagctacaagatgtgcaccgacaagatgtccttcgtcaagaaccccaccgacacggggcacggcaccgccgtgatgcaggtcaaggtgcccaagggggcgccctgccgcatcccggtgatggtggccgacgacctgaccgccgccgtcaacaagggcatcctcgtgaccgtgaaccccatcgccagcaccaacgacgacgaggtcctgatcgaggtgaacccgcccttcggcgactcctacatcatcgtggggacgggcgacagccggctgacctaccagtggcacaaggaggggtccagcatcggcaagctgttcacccagaccatgaagggggcggagcgcctcgccgtcatgggcgacgccgcctgggacttcggctccgccgggggcttcttcacgagcgtggggaagggcatccacaccgtgttcgggtccgcgttccagggcctgttcggcgggctgagctggatcaccaaggtcatcatgggcgtggtgctcatctgggtcgggatcaacacccggaacatgacgatgagcatgtccatgatcctggtgggcgtgatcatgatgttcctgagcctcggggtcggcgccgaccagggctgcgccatcaacttcgggaag

SEQ ID NO: 657 - RNA, 2091 nt, synthetic construct
  misc_feature 1..2091: note = derived and/or modified CDS sequence (opt1) from YFV__HM582851__X-SS-prME-XX
  source 1..2091: mol_type = other RNA
atgcgcggcctgagctcccggaagcgccggagccaggacgtgctcaccgtccagttcctgatcctggggatgctcctgatggtgggcggggtgaccctggtccgccggaaccgctggctcctgctgaacgtgacgtccgaggacctcggcaagaccttcagcgtggggaccggcaactgcaccacgaacatcctggaggccaagtactggtgccccgactccatggagtacaactgccccaacctgagcccccgggaggagcccgacgacatcgactgctggtgctacggcgtcgagaacgtgcgcgtggcctacgggaagtgcgactccgcgggccggagccgccggtcccgccgggccatcgacctccccacccacgagaaccacgggctgaagacccgccaggagaagtggatgaccggccggatgggggagcgccagctgcagaagatcgagcggtggctcgtccgcaacccgttcttcgccgccacggccctggcgatcgcctacctggtgggcagcaacatgacccagcgggtggtcatcgccctcctggtgctggccgtgggccccgcgtactccgcccactgcatcgggatcaccgaccgcgacttcatcgagggcgtccacgggggcacctgggtgagcgccacgctcgagcaggacaagtgcgtgaccgtcatggcccccgacaagccctccctggacatcagcctggagaccgtggccatcgacggcccggcggaggcccggaaggtgtgctactccgccgtcctcaccaacgtgaagatcaacgacaagtgccccagcacgggggaggcccacctggaggaggagaacgagggcgacaacgcctgcaagcgcacctactccgaccgcgggtggggcaacgggtgcggcctgttcggcaaggggagcatcgtggcgtgcgccaagttcacgtgcgccaagtccatgagcctcttcgaggtcgaccagaccaagatccagtacgtgatccgggcccagctgcacgtcggcgccaagcaggagaactggaacaccgacatcaagaccctgaagttcgacgcgctcagcgggtcccaggaggccgagttcaccggctacgggcgcgccaccctggagtgccaggtgcagacggccgtggacttcagcaactcctacatcgccgagatggagaaggagagctggatcgtcgacaagcagtgggcgcaggacctgaccctcccctggcagtccggcagcggcggggtgtggcgggagatgcaccacctggtggagttcgagcccccgcacgccgccaccatcaaggtcctggccctcggcaaccaggaggggtccctgaagaccgcgctgacgggcgccatgcgcgtgaccaaggacaccaacaacagcaagctctacaagctgcacgggggccacgtggcctgccgggtcaagctgtccgccctcaccctgaagggcacgagctacaagatgtgcaccgacaagatgtccttcgtgaagaaccccaccgacaccgggcacggcacggccgtgatgcaggtcaaggtgcccaagggggcgccctgccgcatcccggtgatggtcgccgacgacctgaccgccgccgtgaacaagggcatcctcgtgaccgtcaaccccatcgccagcaccaacgacgacgaggtgctgatcgaggtgaacccgcccttcggcgactcctacatcatcgtcgggaccggcgacagccggctgacgtaccagtggcacaaggaggggtccagcatcggcaagctgttcacccagaccatgaagggggcggagcgcctcgccgtgatgggcgacgccgcctgggacttcggctccgccgggggcttcttcaccagcgtggggaagggcatccacacggtcttcgggtccgcgttccagggcctgttcggcgggctgagctggatcaccaaggtgatcatgggcgtggtcctcatctgggtggggatcaacacccggaacatgaccatgagcatgtccatgatcctggtgggcgtcatcatgatgttcctgagcctcggggtgggcgccgaccagggctgcgccatcaacttcgggaag

SEQ ID NO: 658 - RNA, 2091 nt, synthetic construct
  misc_feature 1..2091: note = derived and/or modified CDS sequence (opt1) from YFV__JN620362__X-SS-prME-XX
  source 1..2091: mol_type = other RNA
atgcgcggcctgagctcccggaagcgccggagcaacgagatgaccatgatgcccctcctgatcctgtccatggtgatcctcgccgggggcgtcaccctggtgcgcaagaaccggtggctgctcctgaacgtgacggccgaggacctggggaagaccttcagcgtcggcaccgggaactgcaccacgaacatcctcgaggcgaagtactggtgcccggactccatggagtacaactgccccaacctgagcccccgcgaggagcccgacgacatcgactgctggtgctacggcgtggagaacgtgcgggtcgcctacggccgctgcgacgccgtggggcggtccaagcgcagccggcgcgccatcgacctgccgacccacgagaaccacggcctcaagacccggcaggagaagtggatgaccgggcgcatgggcgagcggcagctgcagaagatcgagcgctggctggtgcggaaccccttcttcgccatcacggcgctcgccatcgcctacctggtcgggaacaacatgacccagcgcgtggtgatcgccctgctcgtcctggcggtgggccccgcctactccgcccactgcatcggcatcaccgaccgggacttcatcgagggggtgcacggcgggacctgggtcagcgccacgctggagcaggacaagtgcgtgaccgtgatggcccccgacaagccgtccctcgacatcagcctgcagaccgtcgcgatcgacggccccgccgaggcccgcaaggtgtgctactccgccgtgctgacccacgtcaagatcaacgacaagtgccccagcacgggcgaggcccacctcgcggaggagaacgacggggacaacgcctgcaagcggacctactccgaccgcggctgggggaacggctgcgggctgttcggcaagggcagcatcgtggcctgcgccaagttcacgtgcgccaagtccatgagcctgttcgaggtggaccagaccaagatccagtacgtcatccgcgcgcagctccacgtgggggccaagcaggagaactggaacaccgacatcaagaccctgaagttcgacgccctgtccggcagccaggaggccgagttcaccgggtacggcaaggccaccctcgagtgccaggtccagacggcggtggacttcgggaacagctacatcgccgagatggagaaggactcctggatcgtggaccggcagtgggcccaggacctgaccctgccctggcagagcggctccggcgggatctggcgcgagatgcaccacctcgtcgagttcgagccgccccacgccgcgaccatccgggtgctggccctgggcaaccaggaggggagcctcaagaccgccctgacgggcgccatgcgcgtgaccaaggacgagaacgacaacaacctgtacaagctccacgggggccacgtctcctgccgggtgaagctgagcgccctgaccctcaagggcacctcctacaagatgtgcacggacaagatgagcttcgtgaagaaccccaccgacaccgggcacggcaccgtcgtgatgcaggtcaaggtgcccaagggggcgccgtgcaagatccccgtgatcgtggccgacgacctgacggccgccgtcaacaagggcatcctggtgaccgtgaaccccatcgcctccaccaacgacgacgaggtcctcatcgaggtgaacccgcccttcggcgacagctacatcatcgtggggaccggcgactcccgcctgacctaccagtggcacaaggaggggagctccatcggcaagctgttcacgcagaccatgaagggggcggagcggctcgccgtcatgggcgacgccgcctgggacttcagctccgccggcgggttcttcaccagcgtgggcaaggggatccacaccgtgttcggctccgcgttccaggggctgttcggcggcctgagctggatcacgaaggtcatcatgggggccgtgctgatctgggtgggcatcaacacccgcaacatgaccatgtccatgagcatgatcctcgtcggggtgatcatgatgttcctgagcctgggcgtgggggccgaccagggctgcgccgtcaacttcggcaag

SEQ ID NO: 659 - RNA, 2091 nt, synthetic construct
  misc_feature 1..2091: note = derived and/or modified CDS sequence (opt1) from YFV__JN811142__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaccaccgacatcaagacgctgcgcttcgacgccctgagcggcagccaggaggtggagttcatcgggtacggcaaggccaccctcgagtgccaggtccagaccgcggtggacttcgggaactcctacatcgccgagatggagaccgagagctggatcgtggaccggcagtgggcccaggacctgacgctgccctggcagtccggcagcggcggggtctggcgcgagatgcaccacctcgtggagttcgagcccccgcacgccgccaccatccgggtgctggcgctgggcaaccaggaggggtccctcaagaccgccctgaccggcgccatgcgcgtcacgaaggacaccaacgacaacaacctgtacaagctccacgggggccacgtgagctgccgggtgaagctgtccgccctgaccctcaagggcaccagctacaagatctgcacggacaagatgttcttcgtcaagaaccccaccgacaccgggcacggcaccgtggtgatgcaggtcaaggtgtccaagggggcgccctgccgcatccccgtgatcgtcgccgacgacctgaccgccgccatcaacaagggcatcctggtgacggtgaacccgatcgccagcaccaacgacgacgaggtcctcatcgaggtgaacccgcccttcggcgactcctacatcatcgtggggcggggcgacagccgcctgacctaccagtggcacaaggaggggtccagcatcggcaagctgttcacccagacgatgaagggggtcgagcggctcgcggtgatgggcgacaccgcctgggacttctccagcgccggcgggttcttcacctccgtgggcaaggggatccacaccgtcttcggcagcgccttccaggggctgttcggcggcctgaactggatcacgaaggtgatcatgggggccgtgctgatctgggtcggcatcaacacccgcaacatgaccatgtccatgagcatgatcctcgtgggggtgatcatgatgttcctgagcctgggcgtcggggcggaccagggctgcgccatcaacttcggcaag

SEQ ID NO: 660 - RNA, 2091 nt, synthetic construct
  misc_feature 1..2091: note = derived and/or modified CDS sequence (opt1) from YFV__DQ100292__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggcccggaaggtgtgctacaacgcggtcctgacccacgtgaagatcaacgacaagtgcccctccaccggcgaggcccacctcgccgaggagaacgagggggacaacgcctgcaagcgcacctacagcgaccgcggctgggggaacggctgcgggctgttcggcaagggctccatcgtggcctgcgcgaagttcacgtgcgccaagagcatgtccctgttcgaggtcgaccagaccaagatccagtacgtgatccgggcccagctccacgtcggggccaagcaggagaactggaacaccgacatcaagaccctgaagttcgacgccctgagcggcagccaggaggtggagttcatcgggtacggcaaggcgacgctcgagtgccaggtgcagaccgccgtcgacttcgggaactcctacatcgccgagatggagaccgagagctggatcgtggaccgccagtgggcccaggacctgaccctgccctggcagtccggcagcggcggggtgtggcgggagatgcaccacctcgtcgagttcgagcccccgcacgccgcgacgatccgcgtgctggccctgggcaaccaggaggggtccctcaagaccgccctgaccggcgccatgcgggtgaccaaggacacgaacgacaacaacctgtacaagctccacgggggccacgtcagctgccgcgtgaagctgtccgcgctgaccctcaagggcaccagctacaagatctgcaccgacaagatgttcttcgtgaagaaccccacggacaccgggcacggcaccgtcgtgatgcaggtcaaggtgcccaagggggccccctgccggatcccggtgatcgtggccgacgacctgaccgccgccgtcaacaagggcatcctggtgaccgtgaaccccatcgcgtccacgaacgacgacgaggtcctcatcgaggtgaacccgcccttcggcgacagctacatcatcgtggggcgcggcgactcccggctgacctaccagtggcacaaggaggggagctccatcggcaagctgttcacccagaccatgaagggggtcgagcgcctcgccgtgatgggcgacacggcctgggacttcagctccgccggcgggttcttcaccagcgtgggcaaggggatccacaccgtcttcggctccgccttccaggggctgttcggcggcctgaactggatcaccaaggtgatcatgggggcggtgctgatctgggtcggcatcaacacgcggaacatgaccatgagcatgtccatgatcctcgtgggggtgatcatgatgttcctgagcctgggcgtcggggccgaccagggctgcgccatcaacttcggcaag

SEQ ID NO: 661 - RNA, 2091 nt, synthetic construct; identical to SEQ ID NO: 152
  misc_feature 1..2091: note = derived and/or modified CDS sequence (opt1) from YFV__DQ118157__X-SS-prME-XX
  source 1..2091: mol_type = other RNA

SEQ ID NO: 662 - RNA, 2091 nt, synthetic construct
  misc_feature 1..2091: note = derived and/or modified CDS sequence (opt1) from YFV__DQ235229__X-SS-prME-XX
  source 1..2091: mol_type = other RNA
atgatcggcctgagctcccgcaagcggcgcagcaacgagatggccatgatgcccctcctgatcctgtccatggtgatcctcgccgggggcgtcaccctggtgcggaagaaccgctggctgctcctgaacgtgaccgcggaggacctggggaagacgttcagcctcggcaccgggaactgcaccaccaacatcctggaggccaagtactggtgcccggactccatggagtacaactgccccaacctgagcccccgggaggagcccgacgacatcgactgctggtgctacggcgtcgagaacgtgcgcgtggcctacggccggtgcgacgccgtcgggcgctccaagcggagccgccgggccatcgacctcccgacgcacgagaaccacggcctgaagacccgccaggagaagtggatggcggggcggatgggcgagcgccagctgcagaagatcgagcggtggctcgtgcgcaaccccttcttcgccatcaccgccctggccatcgcgtacctggtggggaacaacatgacccagcgggtcgtgatcgccctcctggtgctggccgtcggccccgcctactccgcccactgcatcggcatcacggaccgcgacttcatcgagggggtgcacggcgggacctgggtgagcgcgaccctcgagcagggcaagtgcgtcaccgtgatggcccccgacaagccgtccctggacatcagcctgcagacggtggccatcgacggccccgccgaggcccggaaggtctgctactccgcggtgctcacccacgtgaagatcaacgacaagtgccccagcaccggggaggcccacctggccgaggagaacgacggcgacaacgcctgcaagcgcacctactccgaccgggggtggggcaacgggtgcggcctgttcggcaaggggagcatcgtcgcctgcgcgaagttcacgtgcgccaagtccatgagcctcttcgaggtggaccagaccaagatccagtacgtgatccgcgcccagctgcacgtcggcgccaagcaggagaactggaacaccgacatcaagaccctgaagttcgacgccctctccgggagccaggaggcggagttcacgggctacgggaaggccaccctggagtgccaggtgcagaccgccgtcgacttcggcaacagctacatcgccgagatggagaaggactcctggatcgtggaccgccagtgggcgcaggacctgaccctcccctggcagagcggctccgggggcatctggcgggagatgcaccacctggtggagttcgagccgccccacgccgccacgatccgcgtcctggccctcgggaaccaggagggcagcctgaagaccgccctgaccggggcgatgcgggtgaccaaggacgagaacgacaacaacctctacaagctgcacggcggccacgtgtcctgccgcgtcaagctgagcgccctcacgctgaaggggacctcctacaagatgtgcaccgacaagatgagcttcgtgaagaaccccaccgacacgggccacgggaccgtggtcatgcaggtcaaggtgcccaagggcgccccgtgcaagatccccgtgatcgtggccgacgacctgaccgccgcggtgaacaagggcatcctcgtcaccgtgaaccccatcgcctccacgaacgacgacgaggtgctgatcgaggtcaacccgcccttcggggacagctacatcatcgtgggcaccggggactcccggctgacctaccagtggcacaaggagggcagctccatcgggaagctgttcacccagaccatgaagggcgccgagcgcctcgccgtgatgggcgacgccgcgtgggacttcagctccgccgggggcttcttcacgagcgtcgggaagggcatccacaccgtgttcgggtccgccttccagggcctgttcggcgggctgagctggatcaccaaggtgatcatgggcgccgtcctcatctgggtggggatcaacacccggaacatgacgatgtccatgagcatgatcctggtgggcgtcatcatgatgttcctgagcctcggggtgggcgcggaccagggctgcgccgtgaacttcgggaag

SEQ ID NO: 663 - RNA, 2088 nt, synthetic construct
  misc_feature 1..2088: note = derived and/or modified CDS sequence (opt1) from YFV__DQ322633__X-SS-prME-XX
  source 1..2088: mol_type = other RNA
atgggcctgagctcccgcaagcggcgcagccacgacgtgctcaccgtccagttcctgatcctggggatgctcctgatgaccggcggggtgacgctggtgcggaagaaccgctggctcctgctgaacgtcacctccgaggacctcggcaagaccttcagcgtggggaccggcaactgcacgaccaacatcctggaggccaagtactggtgccccgactccatggagtacaactgccccaacctgagcccccgggaggagcccgacgacatcgactgctggtgctacggcgtggagaacgtccgcgtggcctacgggaagtgcgactccgcgggccggagccgccggtcccgccgggccatcgacctccccacccacgagaaccacgggctgaagacccgccaggagaagtggatgacgggccggatgggggagcgccagctgcagaagatcgagcggtggttcgtgcgcaacccgttcttcgccgtcaccgccctcaccatcgcctacctggtgggcagcaacatgacccagcgggtggtcatcgcgctgctcgtgctggccgtgggccccgcctactccgcccactgcatcgggatcacggaccgcgacttcatcgagggcgtccacgggggcacctgggtgagcgcgaccctggagcaggacaagtgcgtgaccgtcatggcccccgacaagccctccctcgacatcagcctggagacggtggccatcgaccggccggccgaggtgcgcaaggtctgctacaacgccgtgctgacccacgtgaagatcaacgacaagtgcccctccaccggcgaggcgcacctcgccgaggagaacgagggggacaacgcctgcaagcggacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgcgcgcagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccggcagtgggcccaggacctgaccctgccctggcagtccggcagcggcggggtctggcgcgagatgcaccacctcgtggagttcgagcccccgcacgccgccacgatccgggtgctggcgctgggcaaccaggaggggtccctcaagaccgccctgaccggcgccatgcgcgtcaccaaggacacgaacgacaacaacctgtacaagctccacgggggccacgtgagctgccgggtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccgcatccccgtgatcgtcgccgacgacctgaccgccgccatcaacaagggcatcctggtgaccgtgaacccgatcgccagcacgaacgacgacgaggtcctcatcgaggtgaacccgcccttcggcgactcctacatcatcgtggggcggggcgacagccgcctgacctaccagtggcacaaggaggggtccagcatcggcaagctgttcacccagaccatgaagggggtcgagcggctcgcggtgatgggcgacacggcctgggacttctccagcgccggcgggttcttcacctccgtgggcaaggggatccacaccgtcttcggcagcgccttccaggggctgttcggcggcctgaactggatcaccaaggtgatcatgggggccgtgctgatctgggtcggcatcaacacgcgcaacatgaccatgtccatgagcatgatcctcgtgggggtgatcatgatgttcctgagcctgggcgtcggggcggaccagggctgcgccatcaacttcggcaag

SEQ ID NO: 664 - RNA, 2067 nt, synthetic construct
  misc_feature 1..2067: note = derived and/or modified CDS sequence (opt1) from YFV__DQ322634__X-SS-prME-XX
  source 1..2067: mol_type = other RNA
atgcgcagccacgacgtgctgaccgtccagttcctcatcctgggcatgctgctcatgaccgggggcgtgacgctggtgcggaagaaccgctggctgctcctgaacgtcacctccgaggacctggggaagaccttcagcgtgggcaccgggaactgcacgaccaacatcctcgaggccaagtactggtgccccgactccatggagtacaactgccccaacctgagcccccgggaggagcccgacgacatcgactgctggtgctacggcgtggagaacgtccgcgtggcctacggcaagtgcgactccgcggggcggagccgccggtcccgccgggccatcgacctgcccacccacgagaaccacggcctcaagacccgccaggagaagtggatgacggggcggatgggcgagcgccagctgcagaagatcgagcggtggttcgtgcgcaacccgttcttcgccgtcaccgccctgaccatcgcctacctcgtggggagcaacatgacccagcgggtggtcatcgcgctgctggtgctcgccgtgggccccgcctactccgcccactgcatcggcatcacggaccgcgacttcatcgagggggtccacggcgggacctgggtgagcgcgaccctggagcaggacaagtgcgtgaccgtcatggcccccgacaagccctccctggacatcagcctcgagacggtggccatcgaccggccggccgaggtgcgcaaggtctgctacaacgccgtgctgacccacgtgaagatcaacgacaagtgcccctccaccggcgaggcgcacctggccgaggagaacgagggcgacaacgcctgcaagcggacctacagcgaccgcgggtggggcaacgggtgcggcctcttcgggaagggctccatcgtcgcctgcgccaagttcacgtgcgccaagagcatgtccctgttcgaggtggaccagaccaagatccagtacgtcatccgggcgcagctgcacgtgggcgccaagcaggagaactggaacaccgacatcaagaccctcaagttcgacgccctgagcgggtcccaggaggtggagttcatcggctacgggaaggccacgctggagtgccaggtccagaccgcggtggacttcggcaacagctacatcgccgagatggagaccgagagctggatcgtggaccgccagtgggcccaggacctcaccctgccctggcagtccgggagcggcggcgtctggcgcgagatgcaccacctggtggagttcgagcccccgcacgccgccacgatccgggtgctcgcgctggggaaccaggagggctccctgaagaccgccctcaccggggccatgcgcgtcaccaaggacacgaacgacaacaacctgtacaagctgcacggcgggcacgtgagctgccgggtgaagctctccgccctgaccctgaagggcaccagctacaagatctgcaccgacaagatgttcttcgtcaagaaccccacggacaccggccacgggaccgtggtgatgcaggtcaaggtgtccaagggcgcgccctgccgcatccccgtgatcgtcgccgacgacctcaccgccgccatcaacaaggggatcctggtgaccgtgaacccgatcgccagcacgaacgacgacgaggtcctgatcgaggtgaacccgcccttcggcgactcctacatcatcgtgggccgcggggacagccggctcacctaccagtggcacaaggagggctccagcatcgggaagctgttcacccagaccatgaagggcgtcgagcggctggcggtgatgggggacacggcctgggacttctccagcgccggcggcttcttcacctccgtggggaagggcatccacaccgtcttcgggagcgccttccagggcctcttcgggggcctgaactggatcaccaaggtgatcatgggcgccgtgctgatctgggtcgggatcaacacgcgcaacatgaccatgtccatgagcatgatcctggtgggcgtgatcatgatgttcctctccctgggggtcggcgcggaccaggggtgcgccatcaacttcggcaag

SEQ ID NO: 665 - RNA, 2061 nt, synthetic construct
  misc_feature 1..2061: note = derived and/or modified CDS sequence (opt1) from YFV__DQ322642__X-SS-prME-XX
  source 1..2061: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaacaccgacatcaagaccctgaagttcgacgccctgagcggcagccaggaggtggagttcatcgggtacggcaaggccacgctcgagtgccaggtccagaccgcggtggacttcgggaactcctacatcgccgagatggagaccgagagctggatcgtggaccgccagtgggcccaggacctgaccctgccctggcagtccggcagcggcggggtctggcgggagatgcaccacctcgtggagttcgagcccccgcacgccgccacgatccgcgtgctggcgctgggcaaccaggaggggtccctcaagaccgccctgaccggcgccatgcgggtcaccaaggacacgaacgacaacaacctgtacaagctccacgggggccacgtgagctgccgcgtgaagctgtccgccctgaccctcaagggcaccagctacaagatctgcaccgacaagatgttcttcgtcaagaaccccacggacaccgggcacggcaccgtggtgatgcaggtcaaggtgtccaagggggcgccctgccggatccccgtgatcgtcgccgacgacctgaccgccgccatcaacaagggcatcctggtgaccgtgaacccgatcgccagcacgaacgacgacgaggtcctcatcgaggtgaacccgcccttcggcgactcctacatcatcgtggggcgcggcgacagccggctgacctaccagtggcacaaggaggggtccagcatcggcaagctgttcacccagaccatgaagggggtcgagcgcctcgcggtgatgggcgacacggcctgggacttctccagcgccggcgggttcttcacctccgtgggcaaggggatccacaccgtcttcggcagcgccttccaggggctgttcggcggcctgaactggatcaccaaggtgatcatgggggccgtgctgatctgggtcggcatcaacacgcggaacatgaccatgtccatgagcatgatcctcgtgggggtgatcatgatgttcctgagcctgggcgtcggggcg

SEQ ID NO: 666 - RNA, 2091 nt, synthetic construct
  misc_feature 1..2091: note = derived and/or modified CDS sequence (opt1) from YFV__GQ379162__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggcccggaaggtgtgctacaacgcggtcctgacccacgtgaagatcaacgacaagtgcccctccaccggcgaggcccacctcgccgaggagaacgagggggacaacgcctgcaagcgcacctacagcgaccgcggctgggggaacggctgcgggctgttcggcaagggctccatcgtggcctgcgcgaagttcacgtgcgccaagagcatgtccctgttcgaggtcgaccagaccaagatccagtacgtgatccgggcccagctccacgtcggggccaagcaggagaactggaacaccagcatcaagaccctgaagttcgacgccctgagcggctcccaggaggtggagttcatcgggtacggcaaggcgacgctcgagtgccaggtgcagaccgccgtcgacttcgggaacagctacatcgccgagatggagaccgagtcctggatcgtggaccgccagtgggcccaggacctgaccctgccctggcagagcggctccggcggggtgtggcgggagatgcaccacctcgtcgagttcgagcccccgcacgccgcgacgatccgcgtgctggccctgggcaaccaggaggggagcctcaagaccgccctgaccggcgccatgcgggtgaccaaggacacgaacgacaacaacctgtacaagctccacgggggccacgtctcctgccgcgtgaagctgagcgcgctgaccctcaagggcacctcctacaagatctgcaccgacaagatgttcttcgtgaagaaccccacggacaccgggcacggcaccgtcgtgatgcaggtcaaggtgcccaagggggccccctgccggatcccggtgatcgtggccgacgacctgaccgccgccatcaacaagggcatcctggtcaccgtgaaccccatcgcgagcacgaacgacgacgaggtgctcatcgaggtcaacccgcccttcggcgactcctacatcatcgtggggcgcggcgacagccggctgacctaccagtggcacaaggaggggtccagcatcggcaagctgttcacccagaccatgaagggggtggagcgcctcgccgtcatgggcgacgtggcctgggacttctccagcgccggcgggttcttcacgtccgtgggcaaggggatccacaccgtcttcggcagcgccttccaggggctgttcggcggcctgaactggatcaccaaggtgatcatgggggcggtgctgatctgggtcggcatcaacacccggaacatgacgatgtccatgagcatgatcctcgtgggggtgatcatgatgttcctgagcctgggcgtcggggccgaccagggctgcgccatcaacttcggcaag

SEQ ID NO: 667 - RNA, 2085 nt, synthetic construct
  misc_feature 1..2085: note = derived and/or modified CDS sequence (opt1) from YFV__DQ859065__X-SS-prME-XX
  source 1..2085: mol_type = other RNA
atgctgaagggcgtgagcgggcgcaagaagcggcgctccgtcgaggccaccggcttcgtgagcaccctcctgttcgggatcgtgctgacggcctccgtcagccggcacgcgcaccacaccctcctgaacgtgaccaaggaggacaccaaccagatcctgacgctccgcaacggcaactgcaccgtggtctccatggacgtggggagctggtgcgacgacaacgtggagtacgactgcgtcaccctgcaggacaacgaggagcccgacgacgtggactgctggtgctacaaggtgaacggcgtccgggtgacctacggcaagtgccgcgaggggaacacgccccggcgctccaagcgggccgtggtcatcaccgcccacctggaccagggcctcaccaccaagaaggagacgtggctggggagctcccacttcgagacccagatccagaagatcgagaagtggatcatccgcaaccccacctacgccatcgccgcgatcatcatggcctggtacatcggcaacagcaccaagcagcgggtggtgctgctcctgctgacgctcgccctggggcccgcctacgcgacccactgcgtcggcatcgccaagcgcgacttcgtgcagggcgtgcaggggaccacctgggtcaacgtggtgatggagcagggcgcctgcgtcacgatcgtgaccgaggggaagccctccgtcgacgtgtggatggagggcatcaccttcagctccccgaccatggtgcggcgcatcagccacacggccaccatctccgacaccaagatcagctccgcctgccccagcaccggcgaggcgaagctggacgaggagcacgacaagacgttcgagtgcaagcggacctactccgaccgcgggtggggcaacgggtgcggcctcttcgggaagggcagcatcgtcgcctgcgccaagttcaccagcaccggccacatggacgtgtacgagatggacatgacgaaggtggagtacaccatcaagacccaggtccactccggggccaagagcgacgacaccacgggcgtgaaggagatcaagttcacccccgtgtccgggacccagaccgtcgagttccccggctacgggaacctgggcctggagtgcatcgtgcagagcgacatcgacttcaccacgcactacctcgtggtcctgggcaccgacgcctggctggtgcacaaggcgtgggtggaggacgtcaccctcccgtggaagcacgagggggccgcctcctggcgggacaagcagtacctggtggagttcggcgagccccacgccgccaccatcaaggtgctggtcctcgggagccaggagggcgcgctgcgcacggccctggccggggccatgatggtgacccacgactccagcgccaagaccttcaagctccacggcggccacgtgacctgcaaggcgaagctgaacgacctggtcatcaaggggacgacctacaccaactgccggggcgggctctccttcgtgaagacccccacggacaccggccacggcaccgtggtcatgcaggtcaaggtgagccgcaacgccccctgccggctgaccgtgatcgccgccgacgacgcgtccgggcacgtgaaccgcggcacgctggtgaccagcaacccgatcgccaactccaacaacgacgaggtcctcgtggaggtgaacccgccctacgggagctcctacctgatcgtcggcaccggggacgacaagctggtgtaccagtggaagaagtccggcagcagcatcggcaagctgttctccgagaccgtgaagggggcccagcgcatggccatcgtcggcagcagctcctgggacttcagctccgccgggggcttcttcagctccgtggggaaggcgctccacacggtgttcggcaccgccttccagggcatcttcgggggcctgagctggatcacccgggtcctcatcggggtgctgctgatctggctcggcctgaactcccgcaacgggatggccaccacggtgatgatgatcaccggcttcgtcatcctgttcctcagcctgggcgtgggggccgagatcggctgctccgtgaactgggggcag

SEQ ID NO: 668 - RNA, 2091 nt, synthetic construct
  misc_feature 1..2091: note = derived and/or modified CDS sequence (opt1) from YFV__KU921608__X-SS-prME-XX
  source 1..2091: mol_type = other RNA
atgcgcggcctggccagccggaagcgccggtccaacgagatggccctcttccccctgctgctcctggggctgctcgcgctgagcggcggggtgaccctggtccgcaagaaccggtggctcctgctgaacgtgaccgccgaggacctcggcaagacgttctccgtggggaccggcaactgcaccaccaacatcctggaggccaagtactggtgcccggacagcatggagtacaactgccccaacctgagcccccgcgaggagcccgacgacatcgactgctggtgctacggcgtcgagaacgtgcgggtggcctacgggcgctgcgacgccgtcggccggtccaagcgctcccggcgcgcgatcgacctcccgacgcacgagaaccacgggctgaagacccggcaggagaagtggatgaccggccgcatgggggagcggcagctgcagaagatcgagcgctggctcgtgcggaaccccttcttcgccgtgaccgccctggccatcgcgtacctggtcggcaacaacacgacccagcgcgtggtgatcgccctcctggtcctggccgtgggccccgcctacagcgcccactgcatcgggatcaccgaccgggacttcatcgagggcgtgcacgggggcacctgggtctccgcgacgctcgagcaggacaagtgcgtgaccgtgatggcccccgacaagccgagcctggacatctccctgcagaccgtcgccatcgacggccccgccgaggcccgcaaggtgtgctacagcgcggtgctcacccacgtcaagatcaacgacaagtgcccctccacgggggaggcccacctggccgaggagaacgacggcgacaacgcctgcaagcggacctacagcgaccgcgggtggggcaacgggtgcggcctgttcggcaaggggtccatcgtggcctgcgcgaagttcacgtgcgccaagagcatgtccctcttcgaggtggaccagaccaagatccagtacgtcatccgcgcccagctgcacgtgggcgccaagcaggagaactggaacaccgacatcaagaccctgaagttcgacgccctcagcgggtcccaggaggcggagttcaccggctacgggaaggccaccctggagtgccaggtccagacggccgtggacttcggcaacagctacatcgccgagatggagaaggacagctggatcgtggaccggcagtgggcgcaggacctgaccctcccctggcagtccggcagcgggggcatctggcgcgagatgcaccacctggtcgagttcgagccgccccacgccgccaccatccgggtgctggccctcgggaaccaggagggctccctgaagaccgccctgacgggggcgatgcgcgtgaccaaggacgagaacgacaacaacctctacaagctgcacggcggccacgtcagctgccgggtgaagctgtccgccctcaccctgaaggggaccagctacaagatgtgcacggacaagatgtccttcgtgaagaaccccaccgacaccggccacgggaccgtcgtgatgcaggtcaaggtgcccaagggcgccccgtgcaagatccccgtgatcgtggccgacgacctgacggccgcggtcaacaagggcatcctcgtgaccgtgaaccccatcgccagcaccaacgacgacgaggtcctgatcgaggtgaacccgcccttcggggactcctacatcatcgtgggcaccggggacagccgcctgacctaccagtggcacaaggagggctccagcatcgggaagctgttcacgcagaccatgaagggcgccgagcggctcgccgtcatgggcgacgccgcgtgggacttctccagcgccgggggcttcttcacctccgtggggaagggcatccacaccgtgttcgggagcgccttccagggcctgttcggcgggctgtcctggatcacgaaggtcatcatgggcgccgtgctcatctgggtggggatcaacacccgcaacatgaccatgagcatgtccatgatcctggtcggcgtgatcatgatgttcctgagcctcggggtgggcgcggaccagggctgcgccgtcaacttcgggaag

SEQ ID NO: 669 - RNA, 2091 nt, synthetic construct
  misc_feature 1..2091: note = derived and/or modified CDS sequence (opt1) from YFV__KX010994__X-SS-prME-XX
  source 1..2091: mol_type = other RNA
atgcgcggcctgagctcccggaagcgccggagcaacgagatggccatgttccccctcctgctgctcgggctgctggccctctccggcggggtgaccctggtccgcaagaaccggtggctgctcctgaacgtgaccgcggaggacctgggcaagacgttcagcgtggggaccggcaactgcaccaccaacatcctcgaggccaagtactggtgcccggactccatggagtacaactgccccaacctgagcccccgcgaggagcccgacgacatcgactgctggtgctacggcgtcgagaacgtgcgggtggcctacgggcgctgcgacgccgtcggccggtccaagcgcagccggcgcgccatcgacctgccgacgcacgagaaccacgggctcaagacccggcaggagaagtggatgaccggccgcatgggggagcggcagctgcagaagatcgagcgctggctggtgcggaaccccttcttcgcggtgaccgccctcgccatcgcctacctggtcggcaacaacacgacccagcgcgtggtgatcgcgctgctcgtcctggccgtgggccccgcctactccgcccactgcatcgggatcaccgaccgggacttcatcgagggcgtgcacgggggcacctgggtcagcgccacgctggagcaggacaagtgcgtgaccgtgatggcgcccgacaagccgtccctcgacatcagcctgcagaccgtcgccatcgacggccccgccgaggcccgcaaggtgtgctactccgccgtgctgacccacgtcaagatcaacgacaagtgccccagcacgggggaggcgcacctcgccgaggagaacgacggcgacaacgcctgcaagcggacctactccgaccgcgggtggggcaacgggtgcggcctgttcggcaaggggagcatcgtggcctgcgccaagttcacgtgcgcgaagtccatgagcctgttcgaggtggaccagaccaagatccagtacgtcatccgcgcccagctccacgtgggcgccaagcaggagaactggaacaccgacatcaagaccctgaagttcgacgccctgtccgggagccaggaggccgagttcaccggctacgggaaggcgaccctcgagtgccaggtccagacggccgtggacttcggcaacagctacatcgccgagatggagaaggactcctggatcgtggaccggcagtgggcccaggacctgaccctgccctggcagagcggctccgggggcatctggcgcgagatgcaccacctcgtcgagttcgagccgccccacgcggccaccatccgggtgctggccctggggaaccaggagggcagcctcaagaccgccctgacgggggccatgcgcgtgaccaaggacgagaacgacaacaacctgtacaagctccacggcggccacgtctcctgccgggtgaagctgagcgcgctgaccctcaaggggacctcctacaagatgtgcacggacaagatgagcttcgtgaagaaccccaccgacaccggccacgggaccgtcgtgatgcaggtcaaggtgcccaagggcgccccgtgcaagatccccgtgatcgtggccgacgacctgacggccgccgtcaacaagggcatcctggtgaccgtgaaccccatcgcgtccaccaacgacgacgaggtcctcatcgaggtgaacccgcccttcggggacagctacatcatcgtgggcaccggggactcccgcctgacctaccagtggcacaaggagggcagctccatcgggaagctgttcacgcagaccatgaagggcgccgagcggctggccgtcatgggcgacgccgcctgggacttcagctccgccgggggcttcttcaccagcgtggggaagggcatccacaccgtgttcgggtccgcgttccagggcctcttcggcgggctgagctggatcacgaaggtcatcatgggcgccgtgctgatctgggtggggatcaacacccgcaacatgaccatgtccatgagcatgatcctcgtcggcgtgatcatgatgttcctgagcctgggggtgggcgccgaccagggctgcgcggtcaacttcgggaag

SEQ ID NO: 670 - RNA, 2091 nt, synthetic construct
  misc_feature 1..2091: note = derived and/or modified CDS sequence (opt1) from YFV__KX027336__X-SS-prME-XX
  source 1..2091: mol_type = other RNA
atgcgcggcctggccagccggaagcgccggtccaacgagatggccatggtgcccctcctgctgctcgggctgctggcgctcagcggcggggtcaccctggtgcgcaagaaccggtggctgctcctgaacgtgaccgccgaggacctgggcaagacgttctccgtcgggaccggcaactgcaccaccaacatcctcgaggccaagtactggtgcccggacagcatggagtacaactgccccaacctgagcccccgcgaggagcccgacgacatcgactgctggtgctacggcgtggagaacgtgcgggtcgcctacgggcgctgcgacgccgtgggccggtccaagcgctcccggcgcgcgatcgacctgccgacgcacgagaaccacgggctcaagacccggcaggagaagtggatgaccggccgcatgggggagcggcagctgcagaagatcgagcgctggctggtgcggaaccccttcttcgccgtcaccgccctcgccatcgcgtacctggtgggcaacaacacgacccagcgcgtggtcatcgccctgctcgtgctggccgtgggccccgcctacagcgcccactgcatcgggatcaccgaccgggacttcatcgagggcgtccacgggggcacctgggtgtccgcgacgctggagcaggacaagtgcgtgaccgtcatggcccccgacaagccgagcctcgacatctccctgcagaccgtggccatcgacggccccgccgaggcccgcaaggtgtgctacagcgcggtcctgacccacgtgaagatcaacgacaagtgcccctccacgggggaggcccacctcgccgaggagaacgacggcgacaacgcctgcaagcggacctacagcgaccgcgggtggggcaacgggtgcggcctgttcggcaaggggtccatcgtggcctgcgcgaagttcacgtgcgccaagagcatgtccctgttcgaggtcgaccagaccaagatccagtacgtgatccgcgcccagctccacgtcggcgccaagcaggagaactggaacaccgacatcaagaccctgaagttcgacgccctgagcgggtcccaggaggcggagttcaccggctacgggaaggccaccctcgagtgccaggtgcagacggccgtggacttcggcaacagctacatcgccgagatggagaaggacagctggatcgtcgaccggcagtgggcgcaggacctgaccctgccctggcagtccggcagcgggggcatctggcgcgagatgcaccacctcgtggagttcgagccgccccacgccgccaccatccgggtgctggccctggggaaccaggagggctccctcaagaccgccctgacgggggcgatgcgcgtcaccaaggacgagaacgacaacaacctgtacaagctccacggcggccacgtgagctgccgggtgaagctgtccgccctgaccctcaaggggaccagctacaagatgtgcacggacaagatgtccttcgtcaagaaccccaccgacaccggccacgggaccgtggtgatgcaggtcaaggtgcccaagggcgccccgtgcaagatccccgtgatcgtcgccgacgacctgacggccgcggtgaacaagggcatcctggtgaccgtcaaccccatcgccagcaccaacgacgacgaggtgctcatcgaggtgaacccgcccttcggggactcctacatcatcgtcggcaccggggacagccgcctgacctaccagtggcacaaggagggctccagcatcgggaagctgttcacgcagaccatgaagggcgccgagcggctggccgtgatgggcgacgccgcgtgggacttctccagcgccgggggcttcttcacctccgtggggaagggcatccacaccgtcttcgggagcgccttccagggcctcttcggcgggctgtcctggatcacgaaggtgatcatgggcgccgtgctgatctgggtcgggatcaacacccgcaacatgaccatgagcatgtccatgatcctcgtgggcgtgatcatgatgttcctgagcctgggggtcggcgcggaccagggctgcgccgtgaacttcgggaag

SEQ ID NO: 671 - RNA, 2091 nt, synthetic construct
  misc_feature 1..2091: note = derived and/or modified CDS sequence (opt1) from YFV__JX898868__X-SS-prME-XX
  source 1..2091: mol_type = other RNA
atgcgcggcctgagctcccggaagcgccggagccacgacgccctcgccgtgcagttcctgatcctggggatgctcctgatggcgggcggggtcaccctggtgcgcaagaaccggtggctcctgctgaacgtgacctccgaggacctcggcaagacgttcagcgtcgggaccggcaactgcaccaccaacatcctggaggccaagtactggtgccccgactccatggagtacaactgccccaacctgagcccccgcgaggagcccgacgacatcgactgctggtgctacggcgtggagaacgtgcgggtcgcctacgggaagtgcgactccgccggccgcagccggcgctcccggcgcgccatcgacctccccacgcacgagaaccacgggctgaagacccggcaggagaagtggatgaccggccgcatgggggagcggcagctgcagaagatcgagcgctggctcgtgcggaacccgttcttcgcggtgaccgccctgacgatcgcctacctggtcggcagcaacatgatgcagcgcgtggtgatcgccctcctggtcctggcggtgggccccgcctactccgcccactgcatcgggatcaccgaccgggacttcatcgagggcgtgcacgggggcacctgggtcagcgccaccctcgagcaggacaagtgcgtgacggtgatggcccccgacaagccctccctggacatcagcctggagaccgtcgcgatcgacggcccggccgaggcccgcaaggtgtgctacaacgccgtgctcacccacgtcaagatcaacgacaagtgcccctccaccggggaggcccacctggcggaggagaacgagggcgacaacgcctgcaagcggacgtacagcgaccgcgggtggggcaacgggtgcggcctgttcggcaaggggtccatcgtggcctgcgccaagttcacgtgcgccaagagcatgtccctcttcgaggtggaccagaccaagatccagtacgtcatccgcgcgcagctgcacgtgggcgccaagcaggagaactggaacaccgacatcaagaccctgaagttcgacgccctcagcgggagccaggaggccgagttcaccggctacgggaaggccaccctggagtgccaggtccagaccgcggtggacttcggcaactcctacatcgccgagatggagaaggagagctggatcgtggaccggcagtgggcccaggacctgacgctcccctggcagtccggcagcgggggcgtctggcgcgagatgcaccacctggtggagttcgagcccccgcacgccgcgaccatccgggtgctggccctcgggaaccaggagggctccctgaagaccgccctgaccggggccatgcgcgtcacgaaggacaccaacgacaacaacctctacaagctgcacggcggccacgtgagctgccgggtgaagctgtccgccctcaccctgaaggggaccagctacaagatgtgcacggacaagatgtccttcgtcaagaaccccaccgacaccggccacgggaccgtggtgatgcaggtcaaggtgcccaagggcgcgccctgcaagatcccggtgatcgtcgccgacgacctgacggccgccatcaacaagggcatcctcgtgaccgtgaaccccatcgccagcaccaacgacgacgaggtcctgatcgaggtgaacccgcccttcggggactcctacatcatcgtgggcaccggggacagccgcctgacctaccagtggcacaaggagggctccagcatcgggaagctgttcacgcagaccatgaagggcgcggagcggctcgccgtcatgggcgacgccgcctgggacttctccagcgccgggggcttcttcacctccgtggggaagggcatccacaccgtgttcgggagcgcgttccagggcctgttcggcgggctgtcctggatcacgaaggtcatcatgggcgccgtgctcatctgggtggggatcaacacccgcaacatgaccatgagcatgagcatgatcctggtcggcgtgatcatgatgttcctgtccctcggggtgggcgccgaccagggctgcgccatcaacttcgggaag

SEQ ID NO: 672 - RNA, 2091 nt, synthetic construct
  misc_feature 1..2091: note = derived and/or modified CDS sequence (opt1) from YFV__JX898869__X-SS-prME-XX
  source 1..2091: mol_type = other RNA
atgcgcggcctgagctcccggaagcgccggagccacgacgtgctcaccgtccagttcctgatcctggggatgctcctgatggccggcggggtgaccctggtgcgcaagaaccggtggctcctgctgaacgtcacgtccgaggacctcggcaagaccttcagcgtggggaccggcaactgcaccacgaacatcctggaggccaagtactggtgccccgactccatggagtacaactgccccaacctgagcccccgcgaggagcccgacgacatcgactgctggtgctacggcgtggagaacgtccgggtggcgtacgggaagtgcgactccgccggccgcagccggcgctcccggcgcgccatcgacctccccacccacgagaaccacgggctgaagacccggcaggagaagtggatgaccggccgcatgggggagcggcagctgcagaagatcgagcgctggctcgtgcggaacccgttcttcgccgtcacggccctgaccatcgcgtacctggtgggcagcaacatgacccagcgcgtggtcatcgccctcctggtgctggccgtgggccccgcctactccgcgcactgcatcgggatcaccgaccgggacttcatcgagggcgtccacgggggcacgtgggtgagcgccaccctcgagcaggacaagtgcgtgaccgtcatggcccccgacaagccctccctggacatcagcctggagaccgtggccatcgacggcccggccgaggcgcgcaaggtgtgctacaacgccgtcctcacgcacgtgaagatcaacgacaagtgcccctccaccggggaggcccacctggccgaggagaacgagggcgacaacgcctgcaagcggacctacagcgaccgcgggtggggcaacgggtgcggcctgttcggcaaggggtccatcgtggcgtgcgccaagttcacgtgcgccaagagcatgtccctcttcgaggtcgaccagaccaagatccagtacgtgatccgcgcccagctgcacgtcggcgccaagcaggagaactggaacaccgacatcaagaccctgaagttcgacgcgctcagcgggagccaggaggccgagttcaccggctacgggaaggccacgctggagtgccaggtgcagaccgccgtggacttcggcaactcctacatcgccgagatggagaaggagagctggatcgtcgaccggcagtgggcgcaggacctgaccctcccctggcagtccggcagcgggggcgtgtggcgcgagatgcaccacctggtggagttcgagcccccgcacgccgccaccatccgggtcctggccctcgggaaccaggagggctccctgaagacggcgctgaccggggccatgcgcgtgaccaaggacaccaacgacaacaacctctacaagctgcacggcggccacgtgagctgccgggtcaagctgtccgccctcacgctgaaggggaccagctacaagatgtgcaccgacaagatgtccttcgtgaagaaccccaccgacacgggccacgggaccgtggtcatgcaggtcaaggtgcccaagggcgccccctgcaagatcccggtgatcgtggccgacgacctgaccgcggccgtgaacaagggcatcctcgtcaccgtgaaccccatcgccagcaccaacgacgacgaggtgctgatcgaggtcaacccgcccttcggggactcctacatcatcgtgggcacgggggacagccgcctgacctaccagtggcacaaggagggctccagcatcgggaagctgttcacccagaccatgaagggcgccgagcggctcgccgtgatgggcgacgcggcctgggacttctccagcgccgggggcttcttcacgtccatcgggaagggcatccacaccgtcttcgggagcgccttccagggcctgttcggcgggctgtcctggatcaccaaggtgatcatgggcgccgtgctcatctgggtcgggatcaacacccgcaacatgacgatgagcatgagcatgatcctggtgggcgtgatcatgatgttcctgtccctcggggtcggcgcggaccagggctgcgccatcaacttcgggaag

SEQ ID NO: 673 - RNA, 2091 nt, synthetic construct
  misc_feature 1..2091: note = derived and/or modified CDS sequence (opt1) from YFV__JX898873__X-SS-prME-XX
  source 1..2091: mol_type = other RNA
atgcgcggcctgagctcccggaagcgccggagccacgacgccctcaccgtgcagctgctgatcctcgggatgatcctgatggccggcggggtcaccctggtgcgcaagaaccggtggctcctgctgaacgtgacgtccgaggacctcggcaagaccttcagcgtcgggaccggcaactgcaccacgaacatcctggaggcgaagtactggtgccccgactccatggagtacaactgccccaacctgagcccccgcgaggagcccgacgacatcgactgctggtgctacggcgtggagaacgtgcgggtcgcctacgggaagtgcgactccgccggccgcagccggcgctcccggcgcgccatcgacctccccacccacgagaaccacgggctgaagacccggcaggagaagtggatgaccggccgcatgggggagcggcagctgcagaagatcgagcgctggctcgtgcggaacccgttcttcgccgtgacggcgctgaccatcgcctacctggtcggcagcaacatgacccagcgcgtggtgatcgccctcctggtcctggccgtgggccccgcgtactccgcccactgcatcgggatcaccgaccgggacttcatcgagggcgtgcacgggggcacgtgggtcagcgccaccctcgagcaggacaagtgcgtgaccgtgatggcccccgacaagccctccctggacatcagcctggagaccgtcgccatcgacggcccggcggaggcccgcaaggtgtgctacaacgccgtgctcacgcacgtcaagatcaacgacaagtgcccctccaccggggaggcccacctggccgaggagaacgagggcgacaacgcgtgcaagcggacctacagcgaccgcgggtggggcaacgggtgcggcctgttcggcaaggggtccatcgtggcctgcgccaagttcacgtgcgccaagagcatgtccctcttcgaggtggaccagaccaagatccagtacgtcatccgcgcccagctgcacgtgggcgcgaagcaggagaactggaacaccgacatcaagaccctgaagttcgacgccctcagcgggagccaggaggccgagttcaccggctacgggaaggccacgctggagtgccaggtccagaccgccgtggacttcggcaactcctacatcgcggagatggagaaggagagctggatcgtggaccggcagtgggcccaggacctgaccctcccctggcagtccggcagcgggggcgtctggcgcgagatgcaccacctggtggagttcgagcccccgcacgccgccaccatccgggtgctggcgctcgggaaccaggagggctccctgaagacggccctgaccggggccacccgcgtcaccaaggacacgaacgacaacaacctctacaagctgcacggcggccacgtgagctgccgggtgaagctgtccgccctcaccctgaaggggaccagctacaagatgtgcaccgacaagatgtccttcgtcaagaaccccacggacaccggccacgggaccgtggtgatgcaggtcaaggtgcccaagggcgccccctgcaagatcccggtgatcgtcgcggacgacctgaccgccgccatcaacaagggcatcctcgtgaccgtgaaccccatcgccagcacgaacgacgacgaggtcctgatcgaggtgaacccgcccttcggggactcctacatcatcgtgggcaccggggacagccgcctgacctaccagtggcacaaggagggctccagcatcgggaagctgttcacccagacgatgaagggcgccgagcggctcgcggtcatgggcgacgccgcctgggacttctccagcgccgggggcttcttcacctccgtggggaagggcatccacaccgtgttcgggagcgccttccagggcctgttcggcgggctgtcctggatcaccaaggtcatcatgggcgcggtgctcatctgggtggggatcaacacgcgcaacatgaccatgagcatgagcatgatcctggtcggcgtgatcatgatgttcctgtccctcggggtgggcgccgaccagggctgcgccatcaacttcgggaag

SEQ ID NO: 674 - RNA, 2091 nt, synthetic construct
  misc_feature 1..2091: note = derived and/or modified CDS sequence (opt1) from YFV__JX898874__X-SS-prME-XX
  source 1..2091: mol_type = other RNA
atgcgcggcctgagctcccggaagcgccggagccacgacgccctcaccgtgcagctgctgatcctcgggatgatcctgatggccggcggggtcaccctggtgcgcaagaaccggtggctcctgctgaacgtgacgtccgaggacctcggcaagaccttcagcgtcgggaccggcaactgcaccacgaacatcctggaggcgaagtactggtgccccgactccatggagtacaactgccccaacctgagcccccgcgaggagcccgacgacatcgactgctggtgctacggcgtggagaacgtgcgggtcgcctacgggaagtgcgactccgccggccgcagccggcgctcccggcgcgccatcgacctccccacccacgagaaccacgggctgaagacccggcaggagaagtggatgaccggccgcatgggggagcggcagctgcagaagatcgagcgctggctcgtgcggaacccgttcttcgccgtgacggcgctgaccatcgcctacctggtcggcagcaacatgacccagcgcgtggtgatcgccctcctggtcctggccgtgggccccgcgtactccgcccactgcatcgggatcaccgaccgggacttcatcgagggcgtgcacgggggcacgtgggtcagcgccaccctcgagcaggacaagtgcgtgaccgtgatggcccccgacaagccctccctggacatcagcctggagaccgtcgccatcgacggcccggcggaggcccgcaaggtgtgctacaacgccgtgctcacgcacgtcaagatcaacgacaagtgcccctccaccggggaggcccacctggccgaggagaacgagggcgacaacgcgtgcaagcggacctacagcgaccgcgggtggggcaacgggtgcggcctgttcggcaaggggtccatcgtggcctgcgccaagttcacgtgcgccaagagcatgtccctcttcgaggtggaccagaccaagatccagtacgtcatccgcgcccagctgcacgtgggcgcgaagcaggagaactggaacaccgacatcaagaccctgaagttcgacgccctcagcgggagccaggaggccgagttcaccggctacgggaaggccacgctggagtgccaggtccagaccgccgtggacttcggcaactcctacatcgcggagatggagaaggagagctggatcgtggaccggcagtgggcccaggacctgaccctcccctggcagtccggcagcgggggcgtctggcgcgagatgcaccacctggtggagttcgagcccccgcacgccgccaccatccgggtgctggcgctcgggaaccaggagggctccctgaagacggccctgaccggggccatgcgcgtcaccaaggacaccaacgacaacaacctctacaagctgcacggcggccacgtgagctgccgggtgaagctgtccgccctcacgctgaaggggaccagctacaagatgtgcaccgacaagatgtccttcgtcaagaaccccaccgacacgggccacgggaccgtggtgatgcaggtcaaggtgcccaagggcgccccctgcaagatcccggtgatcgtcgcggacgacctgaccgccgccatcaacaagggcatcctcgtgaccgtgaaccccatcgccagcaccaacgacgacgaggtcctgatcgaggtgaacccgcccttcggggactcctacatcatcgtgggcacgggggacagccgcctgacctaccagtggcacaaggagggctccagcatcgggaagctgttcacccagaccatgaagggcgccgagcggctcgcggtcatgggcgacgccgcctgggacttctccagcgccgggggcttcttcacgtccgtggggaagggcatccacaccgtgttcgggagcgccttccagggcctgttcggcgggctgtcctggatcaccaaggtcatcatgggcgcggtgctcatctgggtggggatcaacacccgcaacatgacgatgagcatgagcatgatcctggtcggcgtgatcatgatgttcctgtccctcggggtgggcgccgaccagggctgcgccatcaacttcgggaag

SEQ ID NO: 675 - RNA, 2091 nt, synthetic construct
  misc_feature 1..2091: note = derived and/or modified CDS sequence (opt1) from YFV__JX898875__X-SS-prME-XX
  source 1..2091: mol_type = other RNA
atgcgcggcctgagctcccggaagcgccggagccacgacgccctcaccgtgcagctgctgatcctcgggatgatcctgatggccggcggggtcaccctggtgcgcaagaaccggtggctcctgctgaacgtgacgtccgaggacctcggcaagaccttcagcgtcgggaccggcaactgcaccacgaacatcctggaggcgaagtactggtgccccgactccatggagtacaactgccccaacctgagcccccgcgaggagcccgacgacatcgactgctggtgctacggcgtggagaacgtgcgggtcgcctacgggaagtgcgactccgccggccgcagccggcgctcccggcgcgccatcgacctccccacccacgagaaccacgggctgaagacccggcaggagaagtggatgaccggccgcatgggggagcggcagctgcagaagatcgagcgctggctcgtgcggaacccgttcttcgccgtgacggcgctgaccatcgcctacctggtcggcagcaacatgacccagcgcgtggtgatcgccctcctggtcctggccgtgggccccgcgtactccgcccactgcatcgggatcaccgaccgggacttcatcgagggcgtgcacgggggcacgtgggtcagcgccaccctcgagcaggacaagtgcgtgaccgtgatggcccccgacaagccctccctggacatcagcctggagaccgtcgccatcgacggcccggcggaggcccgcaaggtgtgctacaacgccgtgctcacgcacgtcaagatcaacgacaagtgcccctccaccggggaggcccacctggccgaggagaacgagggcgacaacgcgtgcaagcggacctacagcgaccgcgggtggggcaacgggtgcggcctgttcggcaaggggtccatcgtggcctgcgccaagttcacgtgcgccaagagcatgtccctcttcgaggtggaccagaccaagatccagtacgtcatccgcgcccagctgcacgtgggcgcgaagcaggagaactggaacaccgacatcaagaccctgaagttcgacgccctcagcgggagccaggaggccaagttcaccggctacgggaaggccacgctggagtgccaggtccagaccgccgtggacttcggcaactcctacatcgcggagatggagaaggagagctggatcgtggaccggcagtgggcccaggacctgaccctcccctggcagtccggcagcgggggcgtctggcgcgagatgcaccacctggtggagttcgagcccccgcacgccgccaccatccgggtgctggcgctcgggaaccaggagggctccctgaagacggccctgaccggggccatgcgcgtcaccaaggacaccaacgacaacaacctctacaagctgcacggcggccacgtgagctgccgggtgaagctgtccgccctcacgctgaaggggaccagctacaagatgtgcaccgacaagatgtccttcgtcaagaaccccaccgacacgggccacgggaccgtggtgatgcaggtcaaggtgcccaagggcgccccctgcaagatcccggtgatcgtcgcggacgacctgaccgccgccatcaacaagggcatcctcgtgaccgtgaaccccatcgccagcaccaacgacgacgaggtcctgatcgaggtgaacccgcccttcggggactcctacatcatcgtgggcacgggggacagccgcctgacctaccagtggcacaaggagggctccagcatcgggaagctgttcacccagaccatgaagggcgccgagcggctcgcggtcatgggcgacgccgcctgggacttctccagcgccgggggcttcttcacgtccgtggggaagggcatccacaccgtgttcgggagcgccttccagggcctgttcggcgggctgtcctggatcaccaaggtcatcatgggcgcggtgctcatctgggtggggatcaacacccgcaacatgacgatgagcatgagcatgatcctggtcggcgtgatcatgatgttcctgtccctcggggtgggcgccgaccagggctgcgccatcaacttcgggaag

SEQ ID NO: 676 - RNA, 2091 nt, synthetic construct
  misc_feature 1..2091: note = derived and/or modified CDS sequence (opt1) from YFV__JX949181__X-SS-prME-XX
  source 1..2091: mol_type = other RNA
atgcgcggcctgagctcccggaagcgccggagccacgacgtgctcaccgtccagttcctgatcctggggatgctcctgatgaccggcggggtgacgctggtgcgcaagaaccggtggctcctgctgaacgtcacctccgaggacctcggcaagaccttcagcgtggggaccggcaactgcacgaccaacatcctggaggccaagtactggtgccccgactccatggagtacaactgccccaacctgagcccccgcgaggagcccgacgacatcgactgctggtgctacggcgtggagaacgtccgggtggcctacgggaagtgcgactccgcgggccgcagccggcgctcccggcgcgccatcgacctccccacccacgagaaccacgggctgaagacccggcaggagaagtggatgacgggccgcatgggggagcggcagctgcagaagatcgagcgctggttcgtgcggaacccgttcttcgccgtcaccgccctcaccatcgcctacctggtgggcagcaacatgacccagcgcgtggtcatcgcgctgctcgtgctggccgtgggccccgcctactccgcccactgcatcgggatcacggaccgggacttcatcgagggcgtccacgggggcacctgggtgagcgcgaccctggagcaggacaagtgcgtgaccgtcatggcccccgacaagccctccctcgacatcagcctggagacggtggccatcgaccgcccggccgaggtgcggaaggtctgctacaacgccgtgctgacccacgtgaagatcaacgacaagtgcccctccaccggcgaggcgcacctcgccgaggagaacgagggggacaacgcctgcaagcgcacctacagcgaccgcggctgggggaacggctgcgggctgttcggcaagggctccatcgtcgcctgcgccaagttcacgtgcgccaagagcatgtccctgttcgaggtggaccagaccaagatccagtacgtcatccgggcgcagctccacgtgggggccaagcaggagaactggaccaccgacatcaagacgctgaagttcgacgccctgagcggcagccaggaggtggagttcatcgggtacggcaaggccaccctcgagtgccaggtccagaccgcggtggacttcgggaactcctacatcgccgagatggagaccgagagctggatcgtggaccgccagtgggcccaggacctgacgctgccctggcagtccggcagcggcggggtctggcgggagatgcaccacctcgtggagttcgagcccccgcacgccgccaccatccgcgtgctggcgctgggcaaccaggaggggtccctcaagaccgccctgaccggcgccatgcgggtcacgaaggacaccaacgacaacaacctgtacaagctccacgggggccacgtgagctgccgcgtgaagctgtccgccctgaccctcaagggcaccagctacaagatctgcacggacaagatgttcttcgtcaagaaccccaccgacaccgggcacggcaccgtggtgatgcaggtcaaggtgtccaagggggcgccctgccggatccccgtgatcgtcgccgacgacctgaccgccgccatcaacaagggcatcctggtgacggtgaacccgatcgccagcaccaacgacgacgaggtcctcatcgaggtgaacccgcccttcggcgactcctacatcatcgtggggcgcggcgacagccggctgacctaccagtggcacaaggaggggtccagcatcggcaagctgttcacccagacgatgaagggggtcgagcgcctcgcggtgatgggcgacaccgcctgggacttctccagcgccggcgggttcttcacctccgtgggcaaggggatccacaccgtcttcggcagcgccttccaggggctgttcggcggcctgaactggatcacgaaggtgatcatgggggtggtcctgatctgggtgggcatcaacacccggaacatgaccatgtccatgagcatgatcctcgtgggggtcatcatgatgttcctgagcctgggcgtgggggccgaccagggctgcgcgatcaacttcggcaag

SEQ ID NO: 677 - RNA, 2091 nt, synthetic construct
  misc_feature 1..2091: note = derived and/or modified CDS sequence (opt1) from YFV__AY968064__X-SS-prME-XX
  source 1..2091: mol_type = other RNA
atgcgcggcctgagctcccggaagcgccggagcaacgagatggccctcttccccctgctgctcctggggctgctcgccctgtccggcggggtgaccctggtccgcaagaaccggtggctcctgctgaacgtgaccgcggaggacctcggcaagacgttcagcgtggggaccggcaactgcaccaccaacatcctggaggccaagtactggtgcccggactccatggagtacaactgccccaacctgagcccccgcgaggagcccgacgacatcgactgctggtgctacggcgtcgagaacgtgcgggtggcctacgggcgctgcgacgccgtcggccggtccaagcgcagccggcgcgccatcgacctcccgacgcacgagaaccacgggctgaagacccggcaggagaagtggatgaccggccgcatgggggagcggcagctgcagaagatcgagcgctggctcgtgcggaaccccttcttcgcggtgaccgccctggccatcgcctacctggtcggcaacaacacgacccagcgcgtggtgatcgcgctcctggtcctggccgtgggccccgcctactccgcccactgcatcgggatcaccgaccgggacttcatcgagggcgtgcacgggggcacctgggtcagcgccacgctcgagcaggacaagtgcgtgaccgtgatggcgcccgacaagccgtccctggacatcagcctgcagaccgtcgccatcgacggccccgccgaggcccgcaaggtgtgctactccgccgtgctcacccacgtcaagatcaacgacaagtgccccagcacgggggaggcgcacctggccgaggagaacgacggcgacaacgcctgcaagcggacctactccgaccgcgggtggggcaacgggtgcggcctgttcggcaaggggagcatcgtggcctgcgccaagttcacgtgcgcgaagtccatgagcctcttcgaggtggaccagaccaagatccagtacgtcatccgcgcccagctgcacgtgggcgccaagcaggagaactggaacaccgacatcaagaccctgaagttcgacgccctctccgggagccaggaggccgagttcaccggctacgggaaggcgaccctggagtgccaggtccagacggccgtggacttcggcaacagctacatcgccgagatggagaaggactcctggatcgtggaccggcagtgggcccaggacctgaccctcccctggcagagcggctccgggggcatctggcgcgagatgcaccacctggtcgagttcgagccgccccacgcggccaccatccgggtgctggccctcgggaaccaggagggcagcctgaagaccgccctgacgggggccatgcgcgtgaccaaggacgagaacgacaacaacctctacaagctgcacggcggccacgtctcctgccgggtgaagctgagcgcgctcaccctgaaggggacctcctacaagatgtgcacggacaagatgagcttcgtgaagaaccccaccgacaccggccacgggaccgtcgtgatgcaggtcaaggtgcccaagggcgccccgtgcaagatccccgtgatcgtggccgacgacctgacggccgccgtcaacaagggcatcctcgtgaccgtgaaccccatcgcgtccaccaacgacgacgaggtcctgatcgaggtgaacccgcccttcggggacagctacatcatcgtgggcaccggggactcccgcctgacctaccagtggcacaaggagggcagctccatcgggaagctgttcacgcagaccatgaagggcgccgagcggctcgccgtcatgggcgacgccgcctgggacttcagctccgccgggggcttcttcaccagcgtggggaagggcatccacaccgtgttcgggtccgcgttccagggcctgttcggcgggctgagctggatcacgaaggtcatcatgggcgccgtgctcatctgggtggggatcaacacccgcaacatgaccatgtccatgagcatgatcctggtcggcgtgatcatgatgttcctgagcctcggggtgggcgccgaccagggctgcgcggtcaacttcgggaag

SEQ ID NO: 678 - RNA, 2091 nt, synthetic construct
  misc_feature 1..2091: note = derived and/or modified CDS sequence (opt1) from YFV__AY968065__X-SS-prME-XX
  source 1..2091: mol_type = other RNA
atgcgcggcctgagctcccggaagcgccggagctccgagatgaccatgatgcccctcctgatcctgagcatggtgatcctcgggggcggggtcaccctggtgcgcaagaaccggtggctgctcctgaacgtgacggccgaggacctgggcaagaccttctccgtcgggaccggcaactgcaccacgaacatcctcgaggccaagtactggtgcccggacagcatggagtacaactgccccaacctgagcccccgcgaggagcccgacgacatcgactgctggtgctacggcgtggagaacgtgcgggtcgcgtacgggcgctgcgacgccgtgggccggtccaagcgctcccggcgcgccatcgacctgccgacccacgagaaccacgggctcaagacccggcaggagaagtggatgaccggccgcatgggggagcggcagctgcagaagatcgagcgctggctggtgcggaaccccttcttcgccgtcacggccctcgcgatcgcctacctggtgggcaacaacaagacccagcgcgtggtcatcgccctgctcgtgctggccgtgggccccgcgtacagcgcccactgcatcgggatcaccgaccgggacttcatcgagggcgtccacgggggcacctgggtgtccgccagcctggagcaggacaagtgcgtgacggtcatggcccccgacaagccgtccctcgacatcagcctgcagaccgtggccatcgacggccccgcggaggcccgcaaggtgtgctactccgccgtcctgacccacgtgaagatcaacgacaagtgccccagcaccggggaggcccacctcgccgaggagaacgacggcgacaacgcgtgcaagcggacgtactccgaccgcgggtggggcaacgggtgcggcctgttcggcaaggggagcatcgtggcctgcgccaagttcacgtgcgccaagtccatgagcctgttcgaggtcgaccagaccaagatccagtacgtgatccgcgcccagctccacgtcggcgcgaagcaggagaactggaacaccgacatcaagaccctgaagttcgacgccctgagcgggtcccaggaggccgagttcaccggctacgggaaggccaccctcgagtgccaggtgcagaccgccgtggacttcggcaacagctacatcgcggagatggagaaggactcctggatcgtcgaccggcagtgggcccaggacctgacgctgccctggcagagcggctccgggggcatctggcgcgagatgcaccacctcgtggagttcgagccgccccacgccgccaccatccgggtgctggcgctggggaaccaggagggcagcctcaagaccgccctgaccggggccatgcgcgtcacgaaggacgagaacgacaacaacctgtacaagctccacggcggccacgtgtcctgccgggtgaagctgagcgccctgaccctcaaggggacctcctacaagatgtgcaccgacaagatgagcttcgtcaagaaccccacggacaccggccacgggaccgtggtgatgcaggtcaaggtgcccaagggcgccccgtgcaagatccccgtgatcgtcgcggacgacctgaccgccgccgtgaacaagggcatcctggtgacggtcaaccccatcgcctccaccaacgacgacgaggtgctcatcgaggtgaacccgcccttcggggacagctacatcatcgtcggcaccggggactcccgcctgacctaccagtggcacaaggagggcagctccatcgggaagctgttcacccagacgatgaagggcgtggagcggctcgccgtgatgggcgacgcggcctgggacttcagctccgccgggggcttcttcaccagcgtcgggaagggcatccacaccgtgttcgggtccgccttccagggcctgttcggcgggctgagctggatcaccaaggtgatcatgggcgccgtcctgatctgggtggggatcaacacgcgcaacatgaccatgagcatgtccatgatcctcgtgggcgtcatcatgatgttcctgagcctgggggtgggcgcggaccagggctgcgccgtgaacttcgggaag

SEQ ID NO: 679 - RNA, 2061 nt, synthetic construct
  misc_feature 1..2061: note = derived and/or modified CDS sequence (opt2) from YFV__L06480__X-SS-prME-XX
  source 1..2061: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacacctccatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtccccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacgtcgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 680 - RNA, 2091 nt, synthetic construct
  misc_feature 1..2091: note = derived and/or modified CDS sequence (opt2) from YFV__D14458__X-SS-prME-XX
  source 1..2091: mol_type = other RNA
atgcgcggcctctcctcccgcaagcgccgctcctacgaggtcctcaccgtccagttcctcatcctcggcatgctcctcatgaccggcggcgtcaccctcgtccgcaagtcccgctggctcctcctcaacgtcacctccgaggacctcggcaagaccttctccgtcggcaccggcaactgcaccaccaacatcctcgaggccaagaactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcacccacgtcaagatcaacgacaagtgcccctccaccggcgaggcccacctcgccgaggagaacgagggcgaccacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacgccgacatcaagaccctcaagttcgacgccctctccggctcccaggaggccgagttcaccggctacggcaaggccaccctcgagtgccaggtccagaccgccgtcgacttctccaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacggctccaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgcctccgtcaacaagggcatcctcgtcaccgtcaaccccatcgcctccaccaacgaggacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacatggtcttcggctccgccttccagggcctcttcggcggcctctcctggatcaccaaggtcatcatgggcgccgtcctcatctgggtcggcatcaacatgcgcaacatgaccatgtccatgtccatgatcctcgtcggcgtcatcatgatgttcctctccctcggcgtcggcgccgaccagggctgcgccatcaacttcggcaag

SEQ ID NO: 681 - RNA, 2091 nt, synthetic construct
  misc_feature 1..2091: note = derived and/or modified CDS sequence (opt2) from YFV__U21055__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccatgggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgtcgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccgcctccacgtcggcgccaagcaggagaactggaagaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcgaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctcaactggatcaccaaggtcatcatcggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcgccaag

SEQ ID NO: 682 - RNA, 2091 nt, synthetic construct
  misc_feature 1..2091: note = derived and/or modified CDS sequence (opt2) from YFV__U21056__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcggcatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgtcgagcgcctcgccgtcatgggcgacgccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 683 - RNA, 2091 nt, synthetic construct
  misc_feature 1..2091: note = derived and/or modified CDS sequence (opt2) from YFV__U54798__X-SS-prME-XX
  source 1..2091: mol_type = other RNA
atgcgcggcctctcctcccgcaagcgccgctcccacgacgtcctcaccgtccagttcctcatcctcggcatgctcctcatggccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccgcgtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccgaccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcctcttcacctccatcggcaagggctcccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 684 - RNA, 2061 nt, synthetic construct
  misc_feature 1..2061: note = derived and/or modified CDS sequence (opt2) from YFV__AF052440__X-SS-prME-XX
  source 1..2061: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaccaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 685 - RNA, 2091 nt, synthetic construct
  misc_feature 1..2091: note = derived and/or modified CDS sequence (opt2) from YFV__AF052445__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgtcgtcctcatctgggtcggcatcaacacccgcaacatgaccatgtccatgtccatgatcatggtcggcgtcatcatgatgttcctctccctcggcgtcggcgccgaccagggctgcgccatcaacttcggcaag

SEQ ID NO: 686 - RNA, 2091 nt, synthetic construct
  misc_feature 1..2091: note = derived and/or modified CDS sequence (opt2) from YFV__AF094612__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcatgcgcaagaaccgctggctcctcctcaacgtcacctccgaggacctcggcaagaccttctccatcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcacctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcgtcgccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgtcgaggcccgcaaggtctgctacaacgccgtcctcacccacgtcaagatcgacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatcaaggcccagctccacgtcggcgccaagcaggaggactggaagaccgacatcaagaccctcaagttcgacgtcctctccggctcccaggaggccgagttcaccggctacggcaaggtcaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcgaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcatcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcttcaacacccgcaacatgaccatgtccatgtccatgatcctcgtcggcgtcatcatgatgttcctctccctcggcgtcggcgccgaccagggctgcgccatcaacttcggcaag

SEQ ID NO: 687 - RNA, 2091 nt, synthetic construct
  misc_feature 1..2091: note = derived and/or modified CDS sequence (opt2) from YFV__KF769015__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaccaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 688 - RNA, 2091 nt, synthetic construct
  misc_feature 1..2091: note = derived and/or modified CDS sequence (opt2) from YFV__KF769016__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 689 - RNA, 2091 nt, synthetic construct
  misc_feature 1..2091: note = derived and/or modified CDS sequence (opt2) from YFV__KF907504__X-SS-prME-XX
  source 1..2091: mol_type = other RNA
atgcgcggcctctcctcccgcaagcgccgctcccacgaggtcctcaccgtccagttcctcatcctcggcatgctcctcatgaccggcggcgtcaccctcgtccgcaagtcccgctggctcctcctcaacgtcacctccgaggacctcggcaagaccttctccgtcggcaccggcaactgcaccaccaacatcctcgaggccaagaactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcacccacgtcaagatcaacgacaagtgcccctccaccggcgaggcccacctcgccgaggagaacgagggcgaccacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacgccgacatcaagaccctcaagttcgacgccctctccggctcccaggaggccgagttcaccggctacggcaaggccaccctcgagtgccaggtccagaccgccgtcgacttctccaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacggctccaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgcctccgtcaacaagggcatcctcgtcaccgtcaaccccatcgcctccaccaacgaggacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacatggtcttcggctccgccttccagggcctcttcggcggcctctcctggatcaccaaggtcatcatgggcgccgtcctcatctgggtcggcatcaacatgcgcaacatgaccatgtccatgtccatgatcctcgtcggcgtcatcatgatgttcctctccctcggcgtcggcgccgaccagggctgcgccatcaacttcggccgc

SEQ ID NO: 690 - RNA, 2091 nt, synthetic construct
  misc_feature 1..2091: note = derived and/or modified CDS sequence (opt2) from YFV__JF912179__X-SS-prME-XX
  source 1..2091: mol_type = other RNA
atgcgcggcctctcctcccgcaagcgccgctcccaggacgccctcaccgtccagttcctcatcctcggcatgctcctcatggtcggcggcgtcaccctcgtccgccgcaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttctccaag

SEQ ID NO: 691 - RNA, 2091 nt, synthetic construct
  misc_feature 1..2091: note = derived and/or modified CDS sequence (opt2) from YFV__JF912180__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgccgcaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtctcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 692 - RNA, 2091 nt, synthetic construct
  misc_feature 1..2091: note = derived and/or modified CDS sequence (opt2) from YFV__JF912181__X-SS-prME-XX
  source 1..2091: mol_type = other RNA
atgcgcggcctctcctcccgcaagcgccgctcccacgaggtcctcaccgtccacttcctcatcctcggcatgatgctcatgaccggcggcgtcaccctcgtccgcaagtcccgctggctcctcctcaacgtcacctccgaggacctcggcaagaccttctccgtcggcaccggcaactgcaccaccaacatcctcgacgccaagaactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacgccgacatcaagaccctcaagttcgacgccctctccggctcccaggaggccgagttcaccggctacggcaaggccaccctcgagtgccaggtccagaccgccgtcgacttctccaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacgccaacggctccaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgaggacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacatggtcttcggctccgccttccagggcctcttcggcggcctctcctggatcaccaaggtcatcatcggcgccgtcctcatctgggtcggcatcaacatgcgcaacatgaccatgtccatgggcatgatcctcgtcggcgtcatcatgatgttcctctccctcggcgtcggcgccgaccagggctgcgccatcaacttcggcaag

SEQ ID NO: 693 - RNA, 2091 nt, synthetic construct
  misc_feature 1..2091: note = derived and/or modified CDS sequence (opt2) from YFV__JF912182__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcgcctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggccgcgccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 694 - RNA, 2091 nt, synthetic construct
  misc_feature 1..2091: note = derived and/or modified CDS sequence (opt2) from YFV__JF912183__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgccgcaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 695 - RNA, 2091 nt, synthetic construct
  misc_feature 1..2091: note = derived and/or modified CDS sequence (opt2) from YFV__JF912184__X-SS-prME-XX
  source 1..2091: mol_type = other RNA
atgcgcggcctctcctcccgcaagcgccgctcccaggacgccctcaccgtccagttcctcatcctcggcatgctcctcatggtcggcggcgtcaccctcgtccgccgcaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttctccaactcctacatcgccgagcgcgagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 696 - RNA, 2091 nt, synthetic construct
  misc_feature 1..2091: note = derived and/or modified CDS sequence (opt2) from YFV__JF912185__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggccgcgccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 697 - RNA, 2091 nt, synthetic construct
  misc_feature 1..2091: note = derived and/or modified CDS sequence (opt2) from YFV__JF912186__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgccgctcccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 698 - RNA, 2091 nt, synthetic construct
  misc_feature 1..2091: note = derived and/or modified CDS sequence (opt2) from YFV__JF912187__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgccgcaaccgctggctcctcctcaacgtcacctccgaggacctcggcaagaccttctccgtcggcaccggcaactgcaccaccaacatcctcgaggccaagtactggtgctccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggccgcgccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 699 - RNA, 2091 nt, synthetic construct
  misc_feature 1..2091: note = derived and/or modified CDS sequence (opt2) from YFV__JF912189__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgccgcaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgtcaagcaggagaactggaacaccgacatcaagaccctcaagttcgacgccctctccggctcccaggaggccgagttcaccggctacggccgcgccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 700 - RNA, 2061 nt, synthetic construct
  misc_feature 1..2061: note = derived and/or modified CDS sequence (opt2) from YFV__AH005112__X-SS-prME-XX
  source 1..2061: mol_type = other RNA
atgcgcggcctctcctcccgcaagcgccgctcccacgacgtcctcaccgtccagttcctcatcctcggcatgctcctcatggccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagaccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgcgcggccaggagcgcctcgccgtcatgggcgacaccgcctgggacttctcctccgccggcggcttcttcacctccatcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 701 - RNA, 2091 nt, synthetic construct
  misc_feature 1..2091: note = derived and/or modified CDS sequence (opt2) from YFV__FJ654700__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcaccggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgtcaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 702 - RNA, 2091 nt, synthetic construct
  misc_feature 1..2091: note = derived and/or modified CDS sequence (opt2) from YFV__KM388817__X-SS-prME-XX
  source 1..2091: mol_type = other RNA
atgcgcggcctctcctcccgcaagcgccgctcccaggacgtcctcaccgtccagttcctcatcctcggcatgctcctcatggccggcggcgtcaccctcgtccgccgcaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggccgcgccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 703 - RNA, 2091 nt, synthetic construct
  misc_feature 1..2091: note = derived and/or modified CDS sequence (opt2) from YFV__HM582851__X-SS-prME-XX
  source 1..2091: mol_type = other RNA
atgcgcggcctctcctcccgcaagcgccgctcccaggacgtcctcaccgtccagttcctcatcctcggcatgctcctcatggtcggcggcgtcaccctcgtccgccgcaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgccaccgccctcgccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctactccgccgtcctcaccaacgtcaagatcaacgacaagtgcccctccaccggcgaggcccacctcgaggaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggccgcgccaccctcgagtgccaggtccagaccgccgtcgacttctccaactcctacatcgccgagatggagaaggagtcctggatcgtcgacaagcagtgggcccaggacctcaccctcccctggcagtccggctccggcggcgtctggcgcgagatgcaccacctcgtcgagttcgagcccccccacgccgccaccatcaaggtcctcgccctcggcaaccaggagggctccctcaagaccgccctcaccggcgccatgcgcgtcaccaaggacaccaacaactccaagctctacaagctccacggcggccacgtcgcctgccgcgtcaagctctccgccctcaccctcaagggcacctcctacaagatgtgcaccgacaagatgtccttcgtcaagaaccccaccgacaccggccacggcaccgccgtcatgcaggtcaaggtccccaagggcgccccctgccgcatccccgtcatggtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttcggctccgccggcggcttcttcacctccgtcggcaagggcatccacaccgtcttcggctccgccttccagggcctcttcggcggcctctcctggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 704 - RNA, 2091 nt, synthetic construct
  misc_feature 1..2091: note = derived and/or modified CDS sequence (opt2) from YFV__JN620362__X-SS-prME-XX
  source 1..2091: mol_type = other RNA
atgcgcggcctctcctcccgcaagcgccgctccaacgagatgaccatgatgcccctcctcatcctctccatggtcatcctcgccggcggcgtcaccctcgtccgcaagaaccgctggctcctcctcaacgtcaccgccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggccgctgcgacgccgtcggccgctccaagcgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccatcaccgccctcgccatcgcctacctcgtcggcaacaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctccagaccgtcgccatcgacggccccgccgaggcccgcaaggtctgctactccgccgtcctcacccacgtcaagatcaacgacaagtgcccctccaccggcgaggcccacctcgccgaggagaacgacggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggactcctggatcgtcgaccgccagtgggcccaggacctcaccctcccctggcagtccggctccggcggcatctggcgcgagatgcaccacctcgtcgagttcgagcccccccacgccgccaccatccgcgtcctcgccctcggcaaccaggagggctccctcaagaccgccctcaccggcgccatgcgcgtcaccaaggacgagaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccgtcaacttcggcaag

SEQ ID NO: 705 - RNA, 2091 nt, synthetic construct
  misc_feature 1..2091: note = derived and/or modified CDS sequence (opt2) from YFV__JN811142__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaccaccgacatcaagaccctccgcttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 706 - RNA, 2091 nt, synthetic construct
  misc_feature 1..2091: note = derived and/or modified CDS sequence (opt2) from YFV__DQ100292__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtccccaagggcgccccctgccgcatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 707 - RNA, 2091 nt, synthetic construct; identical to SEQ ID NO: 184
  misc_feature 1..2091: note = derived and/or modified CDS sequence (opt2) from YFV__DQ118157__X-SS-prME-XX
  source 1..2091: mol_type = other RNA

SEQ ID NO: 708 - RNA, 2091 nt, synthetic construct
  misc_feature 1..2091: note = derived and/or modified CDS sequence (opt2) from YFV__DQ235229__X-SS-prME-XX
  source 1..2091: mol_type = other RNA
atgatcggcctctcctcccgcaagcgccgctccaacgagatggccatgatgcccctcctcatcctctccatggtcatcctcgccggcggcgtcaccctcgtccgcaagaaccgctggctcctcctcaacgtcaccgccgaggacctcggcaagaccttctccctcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggccgctgcgacgccgtcggccgctccaagcgctcccgccgcgccatcgacctccccacccacgagaaccacggcctcaagacccgccaggagaagtggatggccggccgcatgggcgagcgccagctccagaagatcgagcgctggctcgtccgcaaccccttcttcgccatcaccgccctcgccatcgcctacctcgtcggcaacaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcagggcaagtgcgtcaccgtcatggcccccgacaagccctccctcgacatctccctccagaccgtcgccatcgacggccccgccgaggcccgcaaggtctgctactccgccgtcctcacccacgtcaagatcaacgacaagtgcccctccaccggcgaggcccacctcgccgaggagaacgacggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggactcctggatcgtcgaccgccagtgggcccaggacctcaccctcccctggcagtccggctccggcggcatctggcgcgagatgcaccacctcgtcgagttcgagcccccccacgccgccaccatccgcgtcctcgccctcggcaaccaggagggctccctcaagaccgccctcaccggcgccatgcgcgtcaccaaggacgagaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccgtcaacttcggcaag

SEQ ID NO: 709 - RNA, 2088 nt, synthetic construct
  misc_feature 1..2088: note = derived and/or modified CDS sequence (opt2) from YFV__DQ322633__X-SS-prME-XX
  source 1..2088: mol_type = other RNA
atgggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 710 - RNA, 2067 nt, synthetic construct
  misc_feature 1..2067: note = derived and/or modified CDS sequence (opt2) from YFV__DQ322634__X-SS-prME-XX
  source 1..2067: mol_type = other RNA
atgcgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 711 - RNA, 2061 nt, synthetic construct
  misc_feature 1..2061: note = derived and/or modified CDS sequence (opt2) from YFV__DQ322642__X-SS-prME-XX
  source 1..2061: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgcc

SEQ ID NO: 712 - RNA, 2091 nt, synthetic construct
  misc_feature 1..2091: note = derived and/or modified CDS sequence (opt2) from YFV__GQ379162__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacacctccatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtccccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacgtcgcctgggacttctcctccgccggcggcttcttcacctccgtcggcaagggcatccacaccgtcttcggctccgccttccagggcctcttcggcggcctcaactggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 713 - RNA, 2085 nt, synthetic construct
  misc_feature 1..2085: note = derived and/or modified CDS sequence (opt2) from YFV__DQ859065__X-SS-prME-XX
  source 1..2085: mol_type = other RNA
atgctcaagggcgtctccggccgcaagaagcgccgctccgtcgaggccaccggcttcgtctccaccctcctcttcggcatcgtcctcaccgcctccgtctcccgccacgcccaccacaccctcctcaacgtcaccaaggaggacaccaaccagatcctcaccctccgcaacggcaactgcaccgtcgtctccatggacgtcggctcctggtgcgacgacaacgtcgagtacgactgcgtcaccctccaggacaacgaggagcccgacgacgtcgactgctggtgctacaaggtcaacggcgtccgcgtcacctacggcaagtgccgcgagggcaacaccccccgccgctccaagcgcgccgtcgtcatcaccgcccacctcgaccagggcctcaccaccaagaaggagacctggctcggctcctcccacttcgagacccagatccagaagatcgagaagtggatcatccgcaaccccacctacgccatcgccgccatcatcatggcctggtacatcggcaactccaccaagcagcgcgtcgtcctcctcctcctcaccctcgccctcggccccgcctacgccacccactgcgtcggcatcgccaagcgcgacttcgtccagggcgtccagggcaccacctgggtcaacgtcgtcatggagcagggcgcctgcgtcaccatcgtcaccgagggcaagccctccgtcgacgtctggatggagggcatcaccttctcctcccccaccatggtccgccgcatctcccacaccgccaccatctccgacaccaagatctcctccgcctgcccctccaccggcgaggccaagctcgacgaggagcacgacaagaccttcgagtgcaagcgcacctactccgaccgcggctggggcaacggctgcggcctcttcggcaagggctccatcgtcgcctgcgccaagttcacctccaccggccacatggacgtctacgagatggacatgaccaaggtcgagtacaccatcaagacccaggtccactccggcgccaagtccgacgacaccaccggcgtcaaggagatcaagttcacccccgtctccggcacccagaccgtcgagttccccggctacggcaacctcggcctcgagtgcatcgtccagtccgacatcgacttcaccacccactacctcgtcgtcctcggcaccgacgcctggctcgtccacaaggcctgggtcgaggacgtcaccctcccctggaagcacgagggcgccgcctcctggcgcgacaagcagtacctcgtcgagttcggcgagccccacgccgccaccatcaaggtcctcgtcctcggctcccaggagggcgccctccgcaccgccctcgccggcgccatgatggtcacccacgactcctccgccaagaccttcaagctccacggcggccacgtcacctgcaaggccaagctcaacgacctcgtcatcaagggcaccacctacaccaactgccgcggcggcctctccttcgtcaagacccccaccgacaccggccacggcaccgtcgtcatgcaggtcaaggtctcccgcaacgccccctgccgcctcaccgtcatcgccgccgacgacgcctccggccacgtcaaccgcggcaccctcgtcacctccaaccccatcgccaactccaacaacgacgaggtcctcgtcgaggtcaaccccccctacggctcctcctacctcatcgtcggcaccggcgacgacaagctcgtctaccagtggaagaagtccggctcctccatcggcaagctcttctccgagaccgtcaagggcgcccagcgcatggccatcgtcggctcctcctcctgggacttctcctccgccggcggcttcttctcctccgtcggcaaggccctccacaccgtcttcggcaccgccttccagggcatcttcggcggcctctcctggatcacccgcgtcctcatcggcgtcctcctcatctggctcggcctcaactcccgcaacggcatggccaccaccgtcatgatgatcaccggcttcgtcatcctcttcctctccctcggcgtcggcgccgagatcggctgctccgtcaactggggccag

SEQ ID NO: 714 - RNA, 2091 nt, synthetic construct
  misc_feature 1..2091: note = derived and/or modified CDS sequence (opt2) from YFV__KU921608__X-SS-prME-XX
  source 1..2091: mol_type = other RNA
atgcgcggcctcgcctcccgcaagcgccgctccaacgagatggccctcttccccctcctcctcctcggcctcctcgccctctccggcggcgtcaccctcgtccgcaagaaccgctggctcctcctcaacgtcaccgccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggccgctgcgacgccgtcggccgctccaagcgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggcaacaacaccacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctccagaccgtcgccatcgacggccccgccgaggcccgcaaggtctgctactccgccgtcctcacccacgtcaagatcaacgacaagtgcccctccaccggcgaggcccacctcgccgaggagaacgacggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggactcctggatcgtcgaccgccagtgggcccaggacctcaccctcccctggcagtccggctccggcggcatctggcgcgagatgcaccacctcgtcgagttcgagcccccccacgccgccaccatccgcgtcctcgccctcggcaaccaggagggctccctcaagaccgccctcaccggcgccatgcgcgtcaccaaggacgagaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccgtcaacttcggcaag

SEQ ID NO: 715 - RNA, 2091 nt, synthetic construct
  misc_feature 1..2091: note = derived and/or modified CDS sequence (opt2) from YFV__KX010994__X-SS-prME-XX
  source 1..2091: mol_type = other RNA
atgcgcggcctctcctcccgcaagcgccgctccaacgagatggccatgttccccctcctcctcctcggcctcctcgccctctccggcggcgtcaccctcgtccgcaagaaccgctggctcctcctcaacgtcaccgccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggccgctgcgacgccgtcggccgctccaagcgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggcaacaacaccacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctccagaccgtcgccatcgacggccccgccgaggcccgcaaggtctgctactccgccgtcctcacccacgtcaagatcaacgacaagtgcccctccaccggcgaggcccacctcgccgaggagaacgacggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggactcctggatcgtcgaccgccagtgggcccaggacctcaccctcccctggcagtccggctccggcggcatctggcgcgagatgcaccacctcgtcgagttcgagcccccccacgccgccaccatccgcgtcctcgccctcggcaaccaggagggctccctcaagaccgccctcaccggcgccatgcgcgtcaccaaggacgagaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccgtcaacttcggcaag

SEQ ID NO: 716 - RNA, 2091 nt, synthetic construct
  misc_feature 1..2091: note = derived and/or modified CDS sequence (opt2) from YFV__KX027336__X-SS-prME-XX
  source 1..2091: mol_type = other RNA
atgcgcggcctcgcctcccgcaagcgccgctccaacgagatggccatggtccccctcctcctcctcggcctcctcgccctctccggcggcgtcaccctcgtccgcaagaaccgctggctcctcctcaacgtcaccgccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggccgctgcgacgccgtcggccgctccaagcgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggcaacaacaccacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctccagaccgtcgccatcgacggccccgccgaggcccgcaaggtctgctactccgccgtcctcacccacgtcaagatcaacgacaagtgcccctccaccggcgaggcccacctcgccgaggagaacgacggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggactcctggatcgtcgaccgccagtgggcccaggacctcaccctcccctggcagtccggctccggcggcatctggcgcgagatgcaccacctcgtcgagttcgagcccccccacgccgccaccatccgcgtcctcgccctcggcaaccaggagggctccctcaagaccgccctcaccggcgccatgcgcgtcaccaaggacgagaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccgtcaacttcggcaag

SEQ ID NO: 717 - RNA, 2091 nt, synthetic construct
  misc_feature 1..2091: note = derived and/or modified CDS sequence (opt2) from YFV__JX898868__X-SS-prME-XX
  source 1..2091: mol_type = other RNA
atgcgcggcctctcctcccgcaagcgccgctcccacgacgccctcgccgtccagttcctcatcctcggcatgctcctcatggccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgatgcagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 718 - RNA, 2091 nt, synthetic construct
  misc_feature 1..2091: note = derived and/or modified CDS sequence (opt2) from YFV__JX898869__X-SS-prME-XX
  source 1..2091: mol_type = other RNA
atgcgcggcctctcctcccgcaagcgccgctcccacgacgtcctcaccgtccagttcctcatcctcggcatgctcctcatggccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccatcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 719 - RNA, 2091 nt, synthetic construct
  misc_feature 1..2091: note = derived and/or modified CDS sequence (opt2) from YFV__JX898873__X-SS-prME-XX
  source 1..2091: mol_type = other RNA
atgcgcggcctctcctcccgcaagcgccgctcccacgacgccctcaccgtccagctcctcatcctcggcatgatcctcatggccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccacccgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 720 - RNA, 2091 nt, synthetic construct
  misc_feature 1..2091: note = derived and/or modified CDS sequence (opt2) from YFV__JX898874__X-SS-prME-XX
  source 1..2091: mol_type = other RNA
atgcgcggcctctcctcccgcaagcgccgctcccacgacgccctcaccgtccagctcctcatcctcggcatgatcctcatggccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 721 - RNA, 2091 nt, synthetic construct
  misc_feature 1..2091: note = derived and/or modified CDS sequence (opt2) from YFV__JX898875__X-SS-prME-XX
  source 1..2091: mol_type = other RNA
atgcgcggcctctcctcccgcaagcgccgctcccacgacgccctcaccgtccagctcctcatcctcggcatgatcctcatggccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgacggccccgccgaggcccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccaagttcaccggctacggcaaggccaccctcgagtgccaggtccagaccgccgtcgacttcggcaactcctacatcgccgagatggagaaggagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 722 - RNA, 2091 nt, synthetic construct
  misc_feature 1..2091: note = derived and/or modified CDS sequence (opt2) from YFV__JX949181__X-SS-prME-XX
  source 1..2091: mol_type = other RNA
atgcgcggcctctcctcccgcaagcgccgctcccacgacgtcctcaccgtccagttcctcatcctcggcatgctcctcatgaccggcggcgtcaccctcgtccgcaagaaccgctggctcctcctcaacgtcacctccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggcaagtgcgactccgccggccgctcccgccgctcccgccgcgccatcgacctccccacccacgagaaccacggcctcaagacccgccaggagaagtggatgaccggccgcatgggcgagcgccagctccagaagatcgagcgctggttcgtccgcaaccccttcttcgccgtcaccgccctcaccatcgcctacctcgtcggctccaacatgacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctcgagaccgtcgccatcgaccgccccgccgaggtccgcaaggtctgctacaacgccgtcctcacccacgtcaagatcaacgacaagtgcccctccaccggcgaggcccacctcgccgaggagaacgagggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaccaccgacatcaagaccctcaagttcgacgccctctccggctcccaggaggtcgagttcatcggctacggcaaggccaccctcgagtgccaggtccagaccgccgtcgacttcggcaactcctacatcgccgagatggagaccgagtcctggatcgtcgaccgccagtgggcccaggacctcaccctcccctggcagtccggctccggcggcgtctggcgcgagatgcaccacctcgtcgagttcgagcccccccacgccgccaccatccgcgtcctcgccctcggcaaccaggagggctccctcaagaccgccctcaccggcgccatgcgcgtcaccaaggacaccaacgacaacaacctctacaagctccacggcggccacgtctcctgccgcgtcaagctctccgccctcaccctcaagggcacctcctacaagatctgcaccgacaagatgttcttcgtcaagaaccccaccgacaccggccacggcaccgtcgtcatgcaggtcaaggtctccaagggcgccccctgccgcatccccgtcatcgtcgccgacgacctcaccgccgccatcaacaagggcatcctcgtcaccgtcaaccccatcgcctccaccaacgacgacgaggtcctcatcgaggtcaacccccccttcggcgactcctacatcatcgtcggccgcggcgactcccgcctcacctaccagtggcacaaggagggctcctccatcggcaagctcttcacccagaccatgaagggcgtcgagcgcctcgccgtcatgggcgacaccgcctgggacttctcctccgccggcggcttcttcacctccgtcggcaagggcatccacaccgtcttcggctccgccttccagggcctcttcggcggcctcaactggatcaccaaggtcatcatgggcgtcgtcctcatctgggtcggcatcaacacccgcaacatgaccatgtccatgtccatgatcctcgtcggcgtcatcatgatgttcctctccctcggcgtcggcgccgaccagggctgcgccatcaacttcggcaag

SEQ ID NO: 723 - RNA, 2091 nt, synthetic construct
  misc_feature 1..2091: note = derived and/or modified CDS sequence (opt2) from YFV__AY968064__X-SS-prME-XX
  source 1..2091: mol_type = other RNA
atgcgcggcctctcctcccgcaagcgccgctccaacgagatggccctcttccccctcctcctcctcggcctcctcgccctctccggcggcgtcaccctcgtccgcaagaaccgctggctcctcctcaacgtcaccgccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggccgctgcgacgccgtcggccgctccaagcgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggcaacaacaccacccagcgcgtcgtcatcgccctcctcgtcctcgccgtcggccccgcctactccgcccactgcatcggcatcaccgaccgcgacttcatcgagggcgtccacggcggcacctgggtctccgccaccctcgagcaggacaagtgcgtcaccgtcatggcccccgacaagccctccctcgacatctccctccagaccgtcgccatcgacggccccgccgaggcccgcaaggtctgctactccgccgtcctcacccacgtcaagatcaacgacaagtgcccctccaccggcgaggcccacctcgccgaggagaacgacggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggactcctggatcgtcgaccgccagtgggcccaggacctcaccctcccctggcagtccggctccggcggcatctggcgcgagatgcaccacctcgtcgagttcgagcccccccacgccgccaccatccgcgtcctcgccctcggcaaccaggagggctccctcaagaccgccctcaccggcgccatgcgcgtcaccaaggacgagaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgccgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccgtcaacttcggcaag

SEQ ID NO: 724 - RNA, 2091 nt, synthetic construct
  misc_feature 1..2091: note = derived and/or modified CDS sequence (opt2) from YFV__AY968065__X-SS-prME-XX
  source 1..2091: mol_type = other RNA
atgcgcggcctctcctcccgcaagcgccgctcctccgagatgaccatgatgcccctcctcatcctctccatggtcatcctcggcggcggcgtcaccctcgtccgcaagaaccgctggctcctcctcaacgtcaccgccgaggacctcggcaagaccttctccgtcggcaccggcaactgcaccaccaacatcctcgaggccaagtactggtgccccgactccatggagtacaactgccccaacctctccccccgcgaggagcccgacgacatcgactgctggtgctacggcgtcgagaacgtccgcgtcgcctacggccgctgcgacgccgtcggccgctccaagcgctcccgccgcgccatcgacctccccacccacgagaaccacggcctcaagacccgccaggagaagtggatgaccggccgcatgggcgagcgccagctccagaagatcgagcgctggctcgtccgcaaccccttcttcgccgtcaccgccctcgccatcgcctacctcgtcggcaacaacaagacccagcgcgtcgtcatcgccctcctcgtcctcgccgtcggccccgcctactccgcccactgcatcggcatcaccgaccgcgacttcatcgagggcgtccacggcggcacctgggtctccgcctccctcgagcaggacaagtgcgtcaccgtcatggcccccgacaagccctccctcgacatctccctccagaccgtcgccatcgacggccccgccgaggcccgcaaggtctgctactccgccgtcctcacccacgtcaagatcaacgacaagtgcccctccaccggcgaggcccacctcgccgaggagaacgacggcgacaacgcctgcaagcgcacctactccgaccgcggctggggcaacggctgcggcctcttcggcaagggctccatcgtcgcctgcgccaagttcacctgcgccaagtccatgtccctcttcgaggtcgaccagaccaagatccagtacgtcatccgcgcccagctccacgtcggcgccaagcaggagaactggaacaccgacatcaagaccctcaagttcgacgccctctccggctcccaggaggccgagttcaccggctacggcaaggccaccctcgagtgccaggtccagaccgccgtcgacttcggcaactcctacatcgccgagatggagaaggactcctggatcgtcgaccgccagtgggcccaggacctcaccctcccctggcagtccggctccggcggcatctggcgcgagatgcaccacctcgtcgagttcgagcccccccacgccgccaccatccgcgtcctcgccctcggcaaccaggagggctccctcaagaccgccctcaccggcgccatgcgcgtcaccaaggacgagaacgacaacaacctctacaagctccacggcggccacgtctcctgccgcgtcaagctctccgccctcaccctcaagggcacctcctacaagatgtgcaccgacaagatgtccttcgtcaagaaccccaccgacaccggccacggcaccgtcgtcatgcaggtcaaggtccccaagggcgccccctgcaagatccccgtcatcgtcgccgacgacctcaccgccgccgtcaacaagggcatcctcgtcaccgtcaaccccatcgcctccaccaacgacgacgaggtcctcatcgaggtcaacccccccttcggcgactcctacatcatcgtcggcaccggcgactcccgcctcacctaccagtggcacaaggagggctcctccatcggcaagctcttcacccagaccatgaagggcgtcgagcgcctcgccgtcatgggcgacgccgcctgggacttctcctccgccggcggcttcttcacctccgtcggcaagggcatccacaccgtcttcggctccgccttccagggcctcttcggcggcctctcctggatcaccaaggtcatcatgggcgccgtcctcatctgggtcggcatcaacacccgcaacatgaccatgtccatgtccatgatcctcgtcggcgtcatcatgatgttcctctccctcggcgtcggcgccgaccagggctgcgccgtcaacttcggcaag

SEQ ID NO: 725 - RNA, 2061 nt, synthetic construct
  misc_feature 1..2061: note = derived and/or modified CDS sequence (opt3) from YFV__L06480__X-SS-prME-XX
  source 1..2061: mol_type = other RNA
atgagaggcctgagctccaggaagcggcgctctcacgacgtgctcaccgtccagttccttatcctggggatgttgttaatgacaggaggtgttactctggtgcgaaagaaccgttggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagcaaggaaagtatgctacaacgccgtgctgacacatgtcaagattaatgacaaatgtccctccaccggcgaggctcaccttgccgaagagaacgaaggtgacaatgcatgcaagcggacgtattcagatcgagggtggggaaacggctgtggcctgttcgggaagggaagtatcgtggcttgcgccaaatttacttgcgcgaaaagcatgtctttgttcgaggttgaccagacaaaaatacagtacgtgattcgcgcccagctccacgtcggtgcaaagcaagagaattggaacacctccatcaaaactctgaagtttgatgctttatcaggcagccaggaagtggagttcattgggtacggaaaagccacactggaatgtcaggtacagaccgctgttgactttggcaacagttatatcgccgagatggaaacggagtcttggatcgtggatagacaatgggcacaggacctcacccttccttggcagtccggtagcgggggcgtctggagggagatgcatcacctggtggaatttgagccaccgcatgccgctacaattcgggtcttggcgctaggaaatcaagaaggctcgctgaagactgcactcaccggggccatgcgcgtgacaaaggatactaacgacaataacctgtacaaacttcacggaggtcacgtttcttgcagagtgaagctgtccgctttgaccctcaaaggcacatcatataagatatgtaccgataaaatgtttttcgtaaagaatcccactgacacggggcatggaacagtcgtgatgcaggttaaggtgcctaaaggcgccccatgcaggatccccgtcattgtggcagatgacctgaccgccgctatcaacaagggtatattagtaactgtgaatcctattgccagtaccaacgacgatgaggttctgatcgaagtcaatccacccttcggggacagctacatcattgtgggccgtggagattcccggctaacatatcagtggcacaaagagggctctagcatcgggaagctctttacccagactatgaaaggagtggagcgactggcagtcatgggtgacgttgcgtgggatttctcaagtgctggcgggtttttcacatccgtgggaaagggcattcatacggtgtttggtagcgccttccaagggctttttggcggattgaactggataaccaaggtaatcatgggcgcagtcctgatttgggtggggatcaatactagaaacatgacaatgtctatgtcaatgatcctcgttggagtgattatgatgttcctgagtcttggcgtcggtgcc

SEQ ID NO: 726 - RNA, 2091 nt, synthetic construct
  misc_feature 1..2091: note = derived and/or modified CDS sequence (opt3) from YFV__D14458__X-SS-prME-XX
  source 1..2091: mol_type = other RNA
atgagaggcctgagctccaggaagcggcgctcttacgaggtgctcaccgtccagttccttatcctggggatgttgttaatgacaggaggtgttactctggtgcgaaaatcacgttggctactcctgaacgtaacgagtgaagaccttggcaagacctttagcgtggggacaggaaattgcactaccaacattctggaggccaaaaattggtgtcccgattccatggaatataactgccctaatttgtctccaagagaggaaccggacgatatagactgttggtgctacggcgtcgagaacgtgagggttgcttatggtaagtgtgattcggcagggcggtcacgcagaagcaggcgggccatcgacctccccacacacgagaatcatggactgaaaacccgccaagaaaagtggatgactggccgaatgggcgagagacagctgcagaagattgaaaggtggctcgtgcggaaccctttctttgcggtcacagctttagccatcgcatacctggtggggagtaatatgacccagcgtgtagttattgcccttttggtgctggctgtcggaccagcatattccgcccactgcatcggtataacggatcgcgacttcatcgagggcgtgcatgggggaacttgggtgtctgctaccctagagcaagataaatgtgtcacagttatggcccccgacaagcctagcctcgatatttccctggaaactgtggcgatcgacggcccagcagaggccagaaaagtatgctactcagctgtgcttacccacgtcaagattaacgataaatgtcccagtacaggtgaagcccatctggcagaggaaaatgagggggaccacgcttgcaagaggacctatagcgaccggggatggggcaacggctgtgggttgtttggaaagggttctatcgtggcctgcgcgaaattcacgtgcgccaagtccatgtcactctttgaggttgatcagactaaaatacagtacgtgattcgagcacagctgcacgtcggcgctaagcaagaaaattggaacgccgacatcaaaacattaaagttcgatgctctgagcgggagtcaggaggccgaatttaccggatacggcaaagcaactctcgagtgtcaggtgcagacagccgtagacttctctaattcctatattgctgaaatggagaaggagagctggatcgttgatcgccaatgggcgcaggaccttaccctgccttggcagtcgggttctgggggcgtgtggagagaaatgcatcacttggtcgagtttgaaccaccgcatgcagccacgatcaaggtgctagctctgggaaaccaagagggctccctcaaaaccgccctgacaggggcaatgagggtcactaaggataccaacggatcaaatctttacaaactgcacggtggccacgtgagttgccgggttaagttgagcgccctcacactgaaagggacttcctataagatgtgtaccgacaagatgtctttcgtgaaaaaccccacagataccggacatggcactgctgtaatgcaggtcaaggtgcctaaaggtgccccatgccgcattcccgttatggtggcagacgatttaacggcgagcgtcaataaggggatactggtgacagtaaaccctatcgcttcaaccaatgaagacgaggtgctaattgaggttaacccaccctttggcgacagttacatcatagtcggaactggcgattccagactcacctatcagtggcacaaagaagggagctctattggaaagctgttcacacagaccatgaagggtgccgagaggcttgcagtgatgggcgacgccgcttgggatttctcaagtgccgggggatttttcactagcgtgggcaaaggtatccatatggtctttgggtccgcattccaaggcttgtttggaggcctgtcttggatcacaaaggttattatgggggctgtgctcatctgggtgggaattaatatgcgtaacatgacgatgtcgatgagcatgatactggtaggcgtcatcatgatgttcctttccctgggtgtgggggccgaccagggatgtgcgattaattttggcaaa

SEQ ID NO: 727 - RNA, 2091 nt, synthetic construct
  misc_feature 1..2091: note = derived and/or modified CDS sequence (opt3) from YFV__U21055__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgaaagaaccgttggctactcctgaatgtaacgtcagaggatcttggcaagacctttagtatggggacaggaaactgcactaccaatattctggaagccaaatactggtgtcccgacagcatggagtataactgccctaatttgtccccaagagaggaaccggatgacatagattgttggtgctacggcgtggaaaacgtcagggtggcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgttcggaaccctttcttcgcggtgacagctctcaccatcgcctacttagtcgggagcaatatgacgcagcgtgtggtaattgcactgcttgttttggccgtgggaccagcttatagtgcacattgcatcggtataactgaccgcgattttatcgaaggcgtccacgggggaacctgggtgtccgccacactggagcaagacaaatgtgtgactgtcatggctcccgataagccttctctagacattagcctcgagaccgttgccatcgatggcccagtggaagcgagaaaagtatgctacaacgcagtgctgacacatgtcaagattaatgacaaatgtccctccaccggtgaggcccaccttgctgaagagaacgaaggggacaatgcctgcaagaggacgtattcagatcggggatggggcaacggctgtgggctgttcggaaagggtagtatcgtggcatgcgctaaatttacttgcgccaagagcatgtctttgttcgaggttgaccagacaaaaatacagtacgtgattcgagcgcgcctccacgtcggcgccaagcaggagaattggaaaaccgatatcaagactctgaaatttgacgcattatccgggtcacaagaagctgagttcacaggatacggcaaggccaccctggaatgtcaggtgcagacggctgtagattttggtaacagctatattgccgagatggaaaaggagagttggatcgttgacagacagtgggcacaagatctcacccttccttggcagtctgggtccggcggagtgtggagggagatgcatcacctggtcgaatttgagccaccgcatgccgctacaatccgggtgttggcgctaggcgaccaggaagggagcctgaaaactgcactcaccggagccatgcgcgtcacaaaggatactaacgacaataacctgtacaaacttcacggtggccacgtgtcgtgcagagttaagctgtctgctttgaccctcaaagggacatcctataagatgtgtaccgataagatgtcatttgtgaaaaatcccactgacacgggacatggcacagtagtcatgcaagtgaaggttcctaaaggtgccccatgcaggattcccgtgatagtcgcagacgatctgaccgccgctatcaacaaggggattttagtgactgtaaatcctatcgccagtaccaacgacgatgaggtgctgatagaagttaatccacccttcggcgacagctacattatcgtcggaacaggcgattcccgtctaacctatcagtggcacaaagaggggtctagcatcggaaaactcttcactcagacaatgaagggtgcagagcggctggcggtgatgggcgacgctgcctgggatttttcaagtgcagggggattctttacgtccgtgggcaaaggtattcataccgtcttcgggagcgcctttcagggccttttcggaggcttgaactggatcactaaggttattataggggctgtgctgatctgggtgggaattaatacacgaaacatgaccatgtctatgtcaatgatcctcgtaggcgtcatcatgatgtttctgagtcttggtgtgggggccgaccaaggatgtgcaattaatttcgctaaa

SEQ ID NO: 728 - RNA, 2091 nt, synthetic construct
  misc_feature 1..2091: note = derived and/or modified CDS sequence (opt3) from YFV__U21056__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgaaagaaccgttggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggctcgtgcggaaccctttctttgcggtcacagctttaaccatcgcctacctggtggggagcaatatgacgcagcgtgtagttattgcacttttggtgctggccgtcggaccagcttatagtgcacattgcatcggtataactgaccgcgatttcatcgaaggcgtgcacgggggaacctgggtgtccgccacactagagcaagacaaatgtgtcactgttatggctcccgataagccttctctcgacattagcctggagaccgtggccatcgatggcccagcggaagcaagaaaagtatgctacaacgccgtgcttacacatgtcaagattaatgacaaatgtccctccaccggtgaggctcacctggccgaagagaacgaaggggacaatgcatgcaagaggacgtattcagatcggggatggggcaacggctgtgggttgtttggaaagggtagtatcgtggcttgcgccaaattcacttgcgcgaaaagcatgtctctctttgaggttgaccagacaaaaatacagtacgtgattcgagcccagctgcacgtcggcgcaaagcaagagaattggaacaccgatatcaaaactttaaagttcgacgctctgtccgggtcacaggaagccgagtttacaggatacggcaaagctaccctcgaatgtcaggtgcagacggccgtagatttcggtaacagctatattgcagagatggaaaaggagagttggatcgttgaccgccaatgggcccaggatcttaccctgccttggcagtctgggtccggcggagtgtggagaggcatgcatcacttggtcgagtttgaaccaccgcatgctgcgacaatcagggtgctagcactggggaatcaagagggaagcctcaagactgccctgaccggtgctatgcgggtcacaaaagacactaacgataataacctttacaagctgcacggcgggcacgtgtcgtgccgcgttaaattgtctgccctcaccctgaagggaacatcctataaaatgtgtaccgacaagatgtcattcgtgaagaatcccactgatacgggccatggtacagtagtcatgcaagtgaaagttcctaagggggcaccatgcaggattcccgtgatagtcgccgacgacttaaccgctgccatcaacaaaggcattctggtgactgtaaatcctatcgcaagtaccaacgatgacgaagtgctaatagaggttaatccaccctttggagatagctacattatcgtcggcacaggggactccagactcacctatcagtggcacaaggaaggatctagcatcggtaaactgttcactcagacaatgaagggcgtggagcgtcttgcggtgatgggggatgctgcctgggacttctcaagtgcaggaggctttttcacgtccgtcggtaaggggattcataccgtttttggcagcgccttccagggattgtttggcgggctgaactggatcactaaagtgattatgggagctgtgctcatatgggtaggcatcaatacacggaacatgaccatgtctatgtcaatgattctggtcggtgtgatcatgatgttccttagtctgggggttggagccgatcagggctgtgcaatcaattttggtaag

SEQ ID NO: 729 - RNA, 2091 nt, synthetic construct
  misc_feature 1..2091: note = derived and/or modified CDS sequence (opt3) from YFV__U54798__X-SS-prME-XX
  source 1..2091: mol_type = other RNA
atgagaggcctgagctccaggaagcggcgctctcacgacgtgctcaccgtccagttccttatcctggggatgttgttaatggccggaggtgttacactggtgcgtaaaaaccgatggctactcctgaatgtaacttcagaggatcttggcaagacgtttagtgtggggaccggaaactgcacaactaatattctggaagctaaatactggtgtcccgacagcatggagtataactgccctaatttgtccccaagagaggaaccggatgacatagattgttggtgctacggcgtcgaaaacgtgagggttgcatatggtaagtgtgactctgccgggcggtcgcgcagatcaaggcgggcgatcgatctccccacccatgagaatcacggactgaaaacacgccaagagaagtggatgaccggccgaatgggcgaaagacagctgcagaagattgagaggtggctcgtgcggaaccctttctttgctgtcactgccttagcaatcgcctacctggtggggagcaatatgacacagcgtgtagttattgctcttttggtgctggcagtcggaccagcctatagtgctcattgcatcggtataaccgaccgcgatttcatcgaaggcgtgcacgggggaacgtgggtgtccgccactctagagcaagacaaatgtgtcaccgttatggcgcccgataagccttctctcgacattagcctggagacagtggcaatcgatggcccagccgaagctagaaaagtatgctacaacgccgtgcttactcatgtcaagattaatgacaaatgtccctccaccggtgaggcacacctggctgaagagaacgaaggggacaatgcctgcaagaggacatattcagatcggggatggggcaacggctgtgggttgtttggaaagggtagtatcgtggcgtgcgccaaatttacctgcgcaaagagcatgtctctcttcgaggttgaccagacgaaaatacagtacgtgattcgagctcagctgcacgtcggcgccaagcaagagaattggaacactgatatcaaaacattaaagttcgacgctctgtccgggtcacaggaagccgagtttaccggatacggcaaagcaactctcgaatgtcgcgtgcagacagccgtagatttcggtaacagctatattgctgagatggaaaaggagagttggatcgttgacagacagtgggcgcaagatcttaccctgccttggcagtctgggtccggcggagtgtggagggagatgcatcacttggtcgaatttgagccaccgcatgcagccacgatccgggtgctagctctgggcaatcaggaagggagcctcaagaccgccctgacaggagcaatgcgcgtcactaaagacaccaacgataataacctttacaagctgcacggtggccacgtgtcgtgcagagttaaattgtctgccctcacactgaaggggacttcctataaaatgtgtaccgacaagatgtcattcgtgaagaatcccacagataccgaccatggaactgtagtcatgcaagtgaaagttcctaagggcgctccatgcaaaattcccgtgatagtcgccgacgatttaacggcagcgatcaacaagggtattctggtgacagtaaatcctatcgctagtaccaacgacgatgaggtgctaatagaagttaatccaccctttggggacagctacattatcgtcggcactggagattccaggctcacctatcagtggcacaaagagggctctagcatcgggaagctgttcacacagaccatgaagggagccgagcgtcttgcagtgatgggtgacgccgcttgggatttctcaagtgccggcgggttgtttacttccattggaaaaggcagccatacagtgttcggttctgcatttcaggggctgttcggcggactctcatggatcacgaaggtcattatgggcgctgttctgatatgggtggggatcaacacccggaatatgactatgagtatgagcatgattcttgtgggagtaatcatgatgtttctgtccttgggcgtcggtgccgaccaagggtgtgcgatcaacttcggaaaa

SEQ ID NO: 730 - RNA, 2061 nt, synthetic construct
  misc_feature 1..2061: note = derived and/or modified CDS sequence (opt3) from YFV__AF052440__X-SS-prME-XX
  source 1..2061: mol_type = other RNA
atgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaccactgatatcaaaacactgaagtttgacgcattatccggctcacaggaagtagagttcattgggtacggaaaagctaccctggaatgtcaggttcagacggccgtggattttggcaacagctatatcgctgagatggaaaccgagagttggatcgtcgacagacaatgggcccaggatctcacacttccttggcagtctggttccgggggcgtgtggagggagatgcatcacctggtcgaatttgagccaccgcatgcagccactattcgggtgttggctctaggaaaccaagaaggcagcctgaagaccgcgctcacaggggcaatgcgcgttactaaggacaccaatgataacaatctgtacaaacttcacggaggtcacgtgtcgtgcagagtaaagctgtctgccttgacactcaaaggcacctcctataagatatgtactgacaaaatgtttttcgtcaagaaccccacggatacagggcatggaaccgtggttatgcaagtgaaggtctcaaaaggcgctccttgcaggatcccagtgattgtagccgacgacctgactgcagccatcaataagggtatattagtgaccgttaaccccattgctagtacaaatgatgacgaggtcctgatcgaagtgaaccctccattcggggatagctacatcattgtgggccgtggagactcccggctaacctatcagtggcacaaagagggctctagcatcgggaagctctttactcagacaatgaaaggagtcgagcgactggccgttatgggtgatacggcatgggacttctcaagtgcgggcgggtttttcacctccgtgggaaagggcattcatactgtgtttggtagcgctttccaggggctttttggcggattgaattggataacaaaggtaatcatgggcgccgtcctgatttgggtggggatcaacaccagaaatatgacaatgtctatgtcaatgatcctcgttggagtgattatgatgttcctgagtcttggcgtcggtgca

SEQ ID NO: 731 - RNA, 2091 nt, synthetic construct
  misc_feature 1..2091: note = derived and/or modified CDS sequence (opt3) from YFV__AF052445__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaacaccgatatcaaaactctgaagtttgacgcattatccggctcacaggaagtagagttcattgggtacggaaaagctacactggaatgtcaggttcagaccgccgtggattttggcaacagctatatcgctgagatggaaacggagagttggatcgtcgacagacaatgggcccaggatctcacccttccttggcagtctggttccgggggcgtgtggagggagatgcatcacctggtcgaatttgagccaccgcatgcagccacaattcgggtgttggctctaggaaatcaagaaggcagcctgaagactgcgctcaccggggcaatgcgcgttacaaaggacactaacgataataacctgtacaaacttcacggaggtcacgtgtcgtgcagagtaaagctgtctgccttgaccctcaaaggcacatcctataagatatgtaccgacaaaatgtttttcgtcaagaatcccactgatacggggcatggaacagtggttatgcaagtgaaggtctcaaaaggcgctccttgcaggatcccagtgattgtagccgacgacctgaccgcagccatcaacaagggtatattagtgactgttaatcccattgctagtaccaacgatgacgaggtcctgatcgaagtgaatcctccattcggggatagctacatcattgtgggccgtggagactcccggctaacatatcagtggcacaaagagggctctagcatcgggaagctctttacccagactatgaaaggagtcgagcgactggccgttatgggtgatacagcatgggacttctcaagtgcgggcgggtttttcacgtccgtgggaaagggcattcataccgtgtttggtagcgctttccaggggctttttggcggattgaactggataactaaggtaatcatgggcgtcgtgctgatttgggttgggatcaatacaagaaacatgaccatgtctatgtcaatgatcatggtgggagtcattatgatgttcctcagtctgggcgtgggtgccgatcaggggtgtgcaataaattttggaaaa

SEQ ID NO: 732 - RNA, 2091 nt, synthetic construct
  misc_feature 1..2091: note = derived and/or modified CDS sequence (opt3) from YFV__AF094612__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctgatgcgaaagaaccgttggctactcctgaatgtgacgtcagaggatcttggcaagacctttagtattgggacaggaaactgcactaccaatatactggaagccaaatactggtgtcccgacagcatggagtataactgccctaatttgtccccaagagaggaaccggatgacatcgattgttggtgctacggcgtagaaaacgtgagggtcacatatggtaagtgtgactctgctgggcggtcgcgcagatcaaggcgggcaattgatctccccacccatgagaatcacggactgaaaactcgccaagagaagtggatgacaggccgaatgggcgaaagacagctgcagaagatcgagaggtggttcgtgcggaaccctttcttcgccgttaccgcgctcacgattgcttacttagtggggagcaatatgactcagcgtgtcgtgatcgccctgcttgtattggcagttggaccagcctatagtgctcattgcataggtgtggcagaccgcgattttatcgaaggcgtccacgggggaacctgggtgtccgccacactggagcaagacaaatgtgtgactgtcatggctcccgataagccttctctagacattagcctcgagaccgttgccatcgatggcccagtggaagcgagaaaagtatgctacaacgcagtgctgacacatgtcaagattgacgacaaatgtccctccaccggtgaggcccaccttgctgaagagaatgaaggggataacgcctgcaagaggacgtattcagaccggggatggggcaatggctgtgggctgttcggaaagggtagtatcgtggcatgcgctaaatttacttgcgccaagagcatgtctttgttcgaggttgatcagacaaaaatacagtacgtgattaaggcgcagctccacgtcggcgccaaacaagaggactggaagaccgatatcaaaactctgaagtttgacgtgttatccgggtcacaggaagcagagttcacaggatacggcaaggtaaccctggaatgtcaggttcagacggctgtggattttggtaacagctatattgccgagatggaaaaagagagttggatcgtcgaccgacaatgggctcaggatctcacccttccttggcagtctgggtccggcggagtgtggcgcgagatgcatcacctggtcgaatttgagccaccgcatgccgcaacaatcagagtgttggccctaggcgaccaagaagggagcctgaagactgctctcaccggagcgatgagggttacaaaagatactaatgacaacaacctgtacaaacttcacggtggccacgtgtcgtgccgggtaaaactgtctgcattgaccctcaaggggacatcctataagatgtgtaccgacaaaatgtcatttgtcaagaatcccactgatacgggacatggcacagtggttatgcaagtgaaagtccctaagggtgccccatgcaaaattcccgtgatagtagctgacgatctgaccgccgcaatcaacaaggggattttagtgactgttaatcctatcgccagtaccaacgacgatgaggtcctgatagaagtgaatccacccttcggcgacagctacattatcatcggaacaggcgattcccgcctaacctatcagtggcacaaggaggggtctagcattggaaaactcttcactcagacaatgaagggtgctgagagactggccgtgatgggcgacgcagcgtgggatttttcaagtgctgggggattctttacgtccgtcggcaaaggtatccataccgttttcgggagcgcctttcagggccttttcggaggcttgaactggattactaaggtgataatgggggcagtgctgatctgggtaggatttaatacaaggaacatgaccatgtctatgtcaatgattctcgtcggcgtgatcatgatgttcctgagtcttggtgttggggccgaccagggatgtgctatcaattttggcaaa

SEQ ID NO: 733 - RNA, 2091 nt, synthetic construct
  misc_feature 1..2091: note = derived and/or modified CDS sequence (opt3) from YFV__KF769015__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaccactgatatcaaaacactgaagtttgacgcattatccggctcacaggaagtagagttcattgggtacggaaaagctaccctggaatgtcaggttcagacggccgtggattttggcaacagctatatcgctgagatggaaaccgagagttggatcgtcgacagacaatgggcccaggatctcacacttccttggcagtctggttccgggggcgtgtggagggagatgcatcacctggtcgaatttgagccaccgcatgcagccactattcgggtgttggctctaggaaaccaagaaggcagcctgaagaccgcgctcacaggggcaatgcgcgttactaaggacaccaatgataacaatctgtacaaacttcacggaggtcacgtgtcgtgcagagtaaagctgtctgccttgacactcaaaggcacctcctataagatatgtactgacaaaatgtttttcgtcaagaaccccacggatacagggcatggaaccgtggttatgcaagtgaaggtctcaaaaggcgctccttgcaggatcccagtgattgtagccgacgacctgactgcagccatcaataagggtatattagtgaccgttaaccccattgctagtacaaatgatgacgaggtcctgatcgaagtgaaccctccattcggggatagctacatcattgtgggccgtggagactcccggctaacctatcagtggcacaaagagggctctagcatcgggaagctctttactcagacaatgaaaggagtcgagcgactggccgttatgggtgatacggcatgggacttctcaagtgcgggcgggtttttcacctccgtgggaaagggcattcatactgtgtttggtagcgctttccaggggctttttggcggattgaattggataacaaaggtaatcatgggcgccgtcctgatttgggtggggatcaacaccagaaatatgacaatgtctatgtcaatgatcctcgttggagtgattatgatgttcctgagtcttggcgtcggtgcagatcaggggtgtgccataaactttggaaaa

SEQ ID NO: 734 - RNA, 2091 nt, synthetic construct
  misc_feature 1..2091: note = derived and/or modified CDS sequence (opt3) from YFV__KF769016__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgaaagaaccgttggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggctcgtgcggaaccctttctttgcggtcacagctttaaccatcgcctacctggtggggagcaatatgacgcagcgtgtagttattgcacttttggtgctggccgtcggaccagcttatagtgcacattgcatcggtataactgaccgcgatttcatcgaaggcgtgcacgggggaacctgggtgtccgccacactagagcaagacaaatgtgtcactgttatggctcccgataagccttctctcgacattagcctggagaccgtggccatcgatggcccagcggaagcaagaaaagtatgctacaacgccgtgcttacacatgtcaagattaatgacaaatgtccctccaccggtgaggctcacctggccgaagagaacgaaggggacaatgcatgcaagaggacgtattcagatcggggatggggcaacggctgtgggttgtttggaaagggtagtatcgtggcttgcgccaaattcacttgcgcgaaaagcatgtctctctttgaggttgaccagacaaaaatacagtacgtgattcgagcccagctgcacgtcggcgcaaagcaagagaattggaacaccgatatcaaaactttaaagttcgacgctctgtccgggtcacaggaagccgagtttacaggatacggcaaagctaccctcgaatgtcaggtgcagacggccgtagatttcggtaacagctatattgcagagatggaaaaggagagttggatcgttgaccgccaatgggcccaggatcttaccctgccttggcagtctgggtccggcggagtgtggagagagatgcatcacttggtcgaatttgagccaccgcatgctgcgacaatcagggtgctagcactgggcaatcaagaagggagcctcaagactgccctgaccggagctatgcgggtcacaaaagacactaacgataataacctttacaagctgcacggtggccacgtgtcgtgccgcgttaaattgtctgccctcaccctgaaggggacatcctataaaatgtgtaccgacaagatgtcattcgtgaagaatcccactgatacgggacatggcacagtagtcatgcaagtgaaagttcctaagggtgcaccatgcaaaattcccgtgatagtcgccgacgacttaaccgctgccatcaacaaggggattctggtgactgtaaatcctatcgcaagtaccaacgatgacgaggtgctaatagaagttaatccaccctttggcgatagctacattatcgtcggaacaggcgactccagactcacctatcagtggcacaaagaggggtctagcatcggaaagctgttcactcagacaatgaagggtgcggagaggcttgctgtgatgggcgatgccgcatgggacttctcaagtgccgggggatttttcacgtccgtgggcaaaggtattcataccgtctttgggagcgctttccagggcttgtttggaggcctgaactggatcactaaggttattatgggggccgtgctcatatgggtgggaatcaatacacgtaacatgaccatgtctatgtcaatgattctggtaggcgtcatcatgatgttccttagtctgggtgtgggggcagatcagggatgtgctatcaattttggcaaa

SEQ ID NO: 735 - RNA, 2091 nt, synthetic construct
  misc_feature 1..2091: note = derived and/or modified CDS sequence (opt3) from YFV__KF907504__X-SS-prME-XX
  source 1..2091: mol_type = other RNA
atgagaggcctgagctccaggaagcggcgctctcacgaggtgctcaccgtccagttccttatcctggggatgttgttaatgacaggaggtgttactctggtgcgaaaatcacgttggctactcctgaacgtaacgagtgaagaccttggcaagacctttagcgtggggacaggaaattgcactaccaacattctggaggccaaaaattggtgtcccgattccatggaatacaactgccctaatttgtctccaagagaggaaccggacgatatagactgttggtgctatggcgtcgagaacgtgagggttgcttacggtaagtgtgattcggcagggcggtcacgcagaagcaggcgggccatcgacctccccacacatgagaatcacggactgaaaacccgccaagaaaagtggatgactggccgaatgggcgagagacagctgcagaagattgaaaggtggctcgtgcggaaccctttctttgcggtcacagctttagccatcgcatatctggtggggagtaatatgacccagcgtgtagttattgcccttttggtgctggctgtcggaccagcatactccgcccattgcatcggtataacggatcgcgacttcatcgagggcgtgcacgggggaacttgggtgtctgctaccctagagcaagataaatgtgtcacagttatggcccccgacaagcctagcctcgatatttccctggaaactgtggcgatcgacggcccagcagaggccagaaaagtatgctattcagctgtgcttacccatgtcaagattaacgataaatgtcccagtacaggtgaagcccacctggcagaggaaaatgagggggaccacgcttgcaagaggacctacagcgaccggggatggggcaacggctgtgggttgtttggaaagggttctatcgtggcctgcgcgaaattcacgtgcgccaagtccatgtcactctttgaggttgatcagactaaaatacagtatgtgattcgagcacagctgcatgtcggcgctaagcaagaaaattggaacgccgacatcaaaacattaaagttcgatgctctgagcgggagtcaggaggccgaatttaccggatacggcaaagcaactctcgagtgtcaggtgcagacagccgtagacttctctaattcctacattgctgaaatggagaaggagagctggatcgttgatcgccaatgggcgcaggaccttaccctgccttggcagtcgggttctgggggcgtgtggagagaaatgcaccatttggtcgagtttgaaccaccgcacgcagccacgatcaaggtgctagctctgggaaaccaagagggctccctcaaaaccgccctgacaggggcaatgagggtcactaaggataccaacggatcaaatctttataaactgcacggtggccatgtgagttgccgggttaagttgagcgccctcacactgaaagggacttcctacaagatgtgtaccgacaagatgtctttcgtgaaaaaccccacagataccggacacggcactgctgtaatgcaggtcaaggtgcctaaaggtgccccatgccgcattcccgttatggtggcagacgatttaacggcgagcgtcaataaggggatactggtgacagtaaaccctatcgcttcaaccaatgaagacgaggtgctaattgaggttaacccaccctttggcgacagttatatcatagtcggaactggcgattccagactcacctaccagtggcataaagaagggagctctattggaaagctgttcacacagaccatgaagggtgccgagaggcttgcagtgatgggcgacgccgcttgggatttctcaagtgccgggggatttttcactagcgtgggcaaaggtatccacatggtctttgggtccgcattccaaggcttgtttggaggcctgtcttggatcacaaaggttattatgggggctgtgctcatctgggtgggaattaatatgcgtaacatgacgatgtcgatgagcatgatactggtaggcgtcatcatgatgttcctttccctgggtgtgggggccgaccagggatgtgcgattaattttggccgg

SEQ ID NO: 736 - RNA, 2091 nt, synthetic construct
  misc_feature 1..2091: note = derived and/or modified CDS sequence (opt3) from YFV__JF912179__X-SS-prME-XX
  source 1..2091: mol_type = other RNA
atgagaggcctgagctccaggaagcggcgctctcaggacgccctcaccgtgcaattccttatcctggggatgttgttaatggtcggaggtgttacactggtgcgacgtaacagatggctactcctgaatgtaacttcagaggatcttggcaaaacgtttagtgtggggaccggaaactgcacaactaatattctggaagctaagtactggtgtcccgacagcatggagtataactgccctaatttgtccccaagggaggaaccggatgacatagattgttggtgctacggcgtcgaaaacgtgcgggttgcatatggtaaatgtgactctgccgggcgctcgagaaggtcacggcgcgcgatcgatctccccacccacgagaatcatggactgaagacacgacaggagaaatggatgaccggcagaatgggcgaaaggcagctgcagaagattgagcggtggctcgtgcgtaaccctttctttgctgccactgcattagccatcgcttacctggtcgggagcaatatgacacaacgcgtggtaattgcacttttggttctggccgtgggaccagcttatagtgcccactgcatcggtataaccgacagagatttcatcgaaggcgtccatgggggaacgtgggtgtccgcgactctagagcaggacaagtgtgtgaccgtcatggcacccgataaaccttctctcgacattagcctggagacagttgccatcgatggcccagctgaagccaggaaggtgtgctactccgcagtacttactaacgtgaaaattaatgacaagtgtccctcaaccggtgaggctcacctggaagaggaaaacgagggggacaatgcctgcaaacggacatatagtgatcgaggatggggcaacggctgtgggttgtttggaaagggtagcatcgtcgcgtgcgccaagtttacctgcgcaaaatctatgtccctcttcgaggtggaccagacgaagatacagtacgttattcgcgctcaactgcatgtgggcgccaaacaggaaaattggaacactgatatcaagacattaaaattcgacgctctgtcagggagccaggaggccgaatttaccggatacggcaaggcaactctcgagtgtcaggtccaaacagccgtggatttcagtaactcttatattgctgaaatggagaaagagtcctggatcgtagacaagcagtgggcgcaggatcttaccctgccttggcaaagcggtagtgggggcgtttggagagaaatgcaccacttggtggagtttgaaccaccgcatgcagccacgatcaaggtcctagctctgggaaatcaggagggctctctcaaaaccgccctgacaggggcaatgagggtgactaaggacaccaacaattccaaactttacaagctgcacggaggtcatgtcgcctgccgggtgaaattgtcagctctcacactgaagggcacttcgtataagatgtgtaccgataaaatgagcttcgttaagaaccccacagacaccgggcacggaactgccgtgatgcaggtaaaagtccctaagggcgcaccatgccgcattcccgtgatggttgcggatgacttaacggctgccgtgaataaaggtatactggtcacagtgaaccctatcgcatccaccaatgacgatgaagtactaattgaggtgaacccaccctttggggactcttacatcatagttggcactggagatagcagactcacctatcagtggcacaaggagggctcaagtattgggaagctgttcacacaaaccatgaaaggagccgaaaggcttgctgtcatgggtgacgccgcatgggatttcggctccgctgggggatttttcactagcgtgggcaagggtatccatacagtgtttgggtctgccttccagggcttgtttggaggcctgtcatggatcacgaaagtcattatgggggttgtgctcatctgggtgggaattaatacccgtaacatgactatgagtatgagcatgatactggtaggcgtcatcatgatgttcctttccctgggtgtgggggcggaccagggatgtgccattaatttttctaag

SEQ ID NO: 737 - RNA, 2091 nt, synthetic construct
  misc_feature 1..2091: note = derived and/or modified CDS sequence (opt3) from YFV__JF912180__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgacgtaacagatggctactcctgaatgtgacttcagaggatcttggcaaaacgtttagtgtcgggaccggaaactgcacaactaatattctggaagccaagtactggtgtcccgacagcatggagtataactgccctaatttgtccccaagggaggaaccggatgacatagattgttggtgctacggcgtggaaaacgttcgggtggcttatggtaaatgtgactctgcagggcgctcgagaaggtcacggcgcgccatcgatctccccacccacgagaatcatggactgaagacacgacaggagaaatggatgaccggcagaatgggcgaaaggcagctgcagaagattgagcggtggctcgtccgtaaccctttctttgcggctactgccttagcaatcgcctacctggtggggagcaatatgacacaacgcgtagttattgctcttttggtgctggcagtcggaccagcctatagtgctcactgcatcggtataaccgacagagatttcatcgaaggcgtgcatgggggaacgtgggtgtccgccactctagagcaggacaagtgtgtcaccgttatggcgcccgataaaccttctctcgacattagcctggagacagtggcaatcgatggcccagccgaagctaggaaggtatgctactccgccgtgcttactaacgtcaaaattaatgacaagtgtccctcaaccggtgaggcacacctggaagaggaaaacgagggggacaatgcttgcaaacggacatatagtgatcgaggatggggcaacggctgtgggttgtttggaaagggtagcatcgtggcctgcgcgaagtttacctgcgccaaatctatgtccctcttcgaggttgaccagacgaagatacagtacgtgattcgcgcacaactgcatgtcggcgctaaacaggaaaattggaacactgatatcaagacattaaaattcgacgccctgtcagggagccaggaggctgaatttaccggatacggcaaggccactctcgagtgtcaggtgcaaacagcagtagatttcagtaactcttatattgccgaaatggagaaagagtcctggatcgttgacaagcagtgggctcaggatcttaccctgccttggcaaagcggttctgggggcgtgtggagagaaatgcaccacttggtcgagtttgaaccaccgcatgcggcaacgatcaaggtgctagccctgggaaatcaggagggctcgctcaaaaccgctctgacaggggccatgagggtcactaaggacaccaacaattccaaactttacaagctgcacggaggtcatgtgtcatgccgggttaaattgagtgcactcacactgaagggcactagctataagatgtgtaccgataaaatgtccttcgtgaagaaccccacagacaccgggcacggaactgccgtaatgcaggtcaaagtgcctaagggcgctccatgccgcattcccgttatggtggccgatgacttaacggcagcggtcaataaaggtatactggtgacagtaaaccctatcgcttctaccaatgacgatgaagtgctaattgaggttaacccaccctttggggacagctacatcatagtcggcactggagattcaagactcacctatcagtggcacaaggagggcagttccattgggaagctgttcacacaaaccatgaaaggagccgaaaggcttgcagtgatgggtgacgccgcttgggatttcggcagcgccgggggatttttcacttctgtgggcaagggtatccatacagtctttgggtcagcattccagggcttgtttggaggcctgagttggatcacgaaagttattatgggggtggtgctcatctgggtaggaattaatacccgtaacatgactatgagcatgtccatgatactggtcggcgtgatcatgatgttcctttctctgggtgttggggctgaccagggatgtgccattaattttggcaag

SEQ ID NO: 738 - RNA, 2091 nt, synthetic construct
  misc_feature 1..2091: note = derived and/or modified CDS sequence (opt3) from YFV__JF912181__X-SS-prME-XX
  source 1..2091: mol_type = other RNA
atgagaggcctgagctccaggaagcggcgctctcacgaggtgctcaccgtccatttccttatcctggggatgatgttgatgacaggaggtgttactttagtgcgaaaatcacgttggctgctactcaacgtaacgagtgaagacctgggcaagacctttagcgtggggacaggaaattgcactaccaacattcttgatgccaaaaattggtgtcccgactccatggagtacaactgccctaatctgtctccaagagaggaaccggatgacatagattgttggtgctatggcgtcgaaaacgtgagggttgcttacggtaagtgtgactcggcagggcggtcacgcagaagcaggcgggccatcgatttgcccacacacgagaatcatggactcaaaacccgccaggagaagtggatgactggccgaatgggcgaaagacaactgcagaagattgagaggtggctggtgcggaaccctttctttgcggtcacagctctcgccatcgcatatttagtggggagtaatatgacccagcgtgtagttattgccctgcttgtgttggctgtcggaccagcatactccgcccactgcatcggtataacggaccgcgatttcatcgaaggcgtgcatgggggaacttgggtgtctgctaccctggagcaggacaaatgtgtcacagttatggcccccgataagcctagcctagacatttccctcgagactgtggcgatcgatggcccagcagaagccagaaaagtatgctattcagctgtgctgacccacgtcaagattaacgacaaatgtcccagtacaggtgaggcccaccttgcagaagagaatgaaggggacaacgcttgcaagaggacctacagcgatcggggatggggcaatggctgtgggctgtttggaaagggttctatcgtggcctgcgcgaaattcacgtgcgccaagtccatgtcattgtttgaggttgaccaaactaaaatacagtatgtgattcgagcacagctccatgtcggcgctaagcaggagaactggaatgccgatatcaaaacactgaagttcgacgctttaagcgggagtcaagaagccgagtttaccggatacggcaaagcaactctggaatgtcaggtgcagacagccgtagatttctctaactcctacattgctgagatggaaaaggagagctggatcgttgaccgccagtgggcgcaagatctcacccttccttggcagtcgggttctgggggcgtgtggagagagatgcaccatctggtcgaatttgagccaccgcacgcagccacgatcaaggtgttggctctaggaaaccaggaaggctccctgaaaaccgccctcacaggggcaatgagggtcactaaggacgccaatggatcaaacctgtataaacttcacggtggccatgtgagttgccgggttaagctgagcgctttgaccctcaaagggacatcctacaagatgtgtactgataagatgtctttcgtgaaaaatcccaccgacacaggacacggcaccgccgtaatgcaagtcaaggtgcctaaaggtgcaccatgccgcattcccgttatggtggcggatgacctgactgctgccgtcaacaaggggatattagtgacggtaaatcctatcgcaagcacaaacgaggacgaagtgctgattgaggttaatccaccctttggcgattcatatatcatagtcggaaccggcgacagtagactaacttaccagtggcataaagaggggtccagcattggaaaactcttcacccagacaatgaagggtgccgaaaggctggctgtgatgggcgatgccgcatgggacttctcttcagctgggggatttttcaccagtgtgggcaagggtatccacatggtctttgggagcgccttccagggcctttttggaggcttgtcctggatcactaaggttattatcggggcggtgctgatttgggtgggaataaacatgcgtaatatgacaatgtctatgggcatgatcctcgtaggtgtcattatgatgttcctgtcgcttggggtgggagccgatcaaggctgtgctatcaactttggtaaa

SEQ ID NO: 739 - RNA, 2091 nt, synthetic construct
  misc_feature 1..2091: note = derived and/or modified CDS sequence (opt3) from YFV__JF912182__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgtaaaaaccgatggctactcctgaatgtgacttcagaggatcttggcaagacgtttagtgtcgggaccggaaactgcacaactaatattctggaagccaaatactggtgtcccgacagcatggagtataactgccctaatttgtccccaagagaggaaccggatgacatagattgttggtgctacggcgtggaaaacgttagggtggcttatggtaagtgtgactctgcagggcggtcgcgcagatcaaggcgggccatcgatctccccacccacgagaatcatggactgaaaacacgccaggagaagtggatgaccggccgaatgggcgaaagacagctgcagaagattgagaggtggctcgtccggaaccctttctttgcggctactgccttagcaatcgcctacctggtggggagcaatatgacacaacgtgtagttattgctcttttggtgctggcagtcggaccagcctatagtgctcactgcatcggtataaccgaccgcgatttcatcgaaggcgtgcatgggggaacgtgggtgtccgccactctagagcaggacaaatgtgtcaccgttatggcgcccgataagccttctctcgacattagcctggagacagtggcaatcgatggcccagccgaagctagaaaagtatgctactccgccgtgcttactaacgtcaagattaatgacaaatgtccctcaaccggtgaggcacacctggaagaggaaaacgagggggacaatgcttgcaagaggacatatagtgatcggggatggggcaacggctgtgggttgtttggaaagggtagcatcgtggcctgcgcgaaattcgcctgcgcaaagtctatgtccctctttgaggttgaccagaccaaaatacagtacgtgattcgagctcaactgcatgtcggcgccaagcaggaaaattggaacacggatatcaaaactttaaagttcgacgctctgtcagggagccaggaggccgaatttacaggatacggccgcgcaaccctcgagtgtcaggtgcaaactgccgtagatttcagtaactcttatattgctgaaatggagaaagagtcctggatcgttgacaagcagtgggcgcaggatcttacactgccttggcaaagcggttctgggggcgtgtggagagaaatgcaccacttggtcgagtttgaaccaccgcatgcagccaccatcaaggtgctagctctgggaaatcaggagggctcgctcaaaacggccctgaccggggcaatgagggtcacaaaggacactaacaattccaaactttacaagctgcacggaggtcatgtggcctgccgggttaaattgtcagctctcaccctgaagggcacaagttataagatgtgtactgataaaatgagcttcgtgaagaaccccaccgacacagggcacggaaccgccgtaatgcaggtcaaagtgcctaagggcgcaccatgccgcattcccgttatggtggcggatgacttaactgctgccgtcaataaaggtatactggtgacggtaaaccctatcgcatccacaaatgacgatgaagtgctaattgaggttaacccaccctttggggactcttacatcatagtcggcaccggagatagcagactcacttatcagtggcacaaggagggctcaagtattgggaagctgttcacccaaacaatgaaaggagccgaaaggcttgctgtgatgggtgacgccgcatgggatttcggctccgctgggggatttttcaccagcgtgggcaagggtatccatactgtctttgggtctgccttccagggcttgtttggaggcctgtcatggatcacaaaagttattatgggggtggtgctcatctgggtaggaattaatacgcgtaacatgaccatgagtatgagcatgatactggtcggcgtgatcatgatgttcctttccctgggtgttggggcggaccagggatgtgccattaattttggcaag

SEQ ID NO: 740 - RNA, 2091 nt, synthetic construct
  misc_feature 1..2091: note = derived and/or modified CDS sequence (opt3) from YFV__JF912183__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgacgtaacagatggctactcctgaatgtgacttcagaggatcttggcaaaacgtttagtgtcgggaccggaaactgcacaactaatattctggaagccaagtactggtgtcccgacagcatggagtataactgccctaatttgtccccaagggaggaaccggatgacatagattgttggtgctacggcgtggaaaacgttcgggtggcttatggtaaatgtgactctgcagggcgctcgagaaggtcacggcgcgccatcgatctccccacccacgagaatcatggactgaagacacgacaggagaaatggatgaccggcagaatgggcgaaaggcagctgcagaagattgagcggtggctcgtccgtaaccctttctttgcggctactgccttagcaatcgcctacctggtggggagcaatatgacacaacgcgtagttattgctcttttggtgctggcagtcggaccagcctatagtgctcactgcatcggtataaccgacagagatttcatcgaaggcgtgcatgggggaacgtgggtgtccgccactctagagcaggacaagtgtgtcaccgttatggcgcccgataaaccttctctcgacattagcctggagacagtggcaatcgatggcccagccgaagctaggaaggtatgctactccgccgtgcttactaacgtcaaaattaatgacaagtgtccctcaaccggtgaggcacacctggaagaggaaaacgagggggacaatgcttgcaaacggacatatagtgatcgaggatggggcaacggctgtgggttgtttggaaagggtagcatcgtggcctgcgcgaagtttacctgcgccaaatctatgtccctcttcgaggttgaccagacgaagatacagtacgtgattcgcgcacaactgcatgtcggcgctaaacaggaaaattggaacactgatatcaagacattaaaattcgacgccctgtcagggagccaggaggctgaatttaccggatacggcaaggccactctcgagtgtcaggtgcaaacagcagtagatttcagtaactcttatattgccgaaatggagaaagagtcctggatcgttgacaagcagtgggctcaggatcttaccctgccttggcaaagcggtagtgggggcgtgtggagagaaatgcaccacttggtcgagtttgaaccaccgcatgcggcaacgatcaaggtgctagccctgggaaatcaggagggctctctcaaaaccgctctgacaggggccatgagggtcactaaggacaccaacaattccaaactttacaagctgcacggaggtcatgtggcatgccgggttaaattgtcagccctcacactgaagggcacttcgtataagatgtgtaccgataaaatgagcttcgtgaagaaccccacagacaccgggcacggaactgctgtaatgcaggtcaaagtgcctaagggcgccccatgccgcattcccgttatggtggcagatgacttaacggcggctgtcaataaaggtatactggtgacagtaaaccctatcgcctccaccaatgacgatgaagtgctaattgaggttaacccaccctttggggactcttacatcatagtcggcactggagatagcagactcacctatcagtggcacaaggagggctcaagtattgggaagctgttcacacaaaccatgaaaggagcagaaaggcttgccgtgatgggtgacgctgcctgggatttcggctccgcagggggatttttcactagcgtgggcaagggtatccatacagtctttgggtctgctttccagggcttgtttggaggcctgtcatggatcacgaaagttattatgggggtggtgctcatctgggtaggaattaatacccgtaacatgactatgagtatgagcatgatactggtcggcgtgatcatgatgttcctttccctgggtgttggggccgaccagggatgtgcgattaattttggcaag

SEQ ID NO: 741 - RNA, 2091 nt, synthetic construct
  misc_feature 1..2091: note = derived and/or modified CDS sequence (opt3) from YFV__JF912184__X-SS-prME-XX
  source 1..2091: mol_type = other RNA
atgagaggcctgagctccaggaagcggcgctctcaggacgccctcaccgtgcaattccttatcctggggatgttgttaatggtcggaggtgttacactggtgcgacgtaacagatggctactcctgaatgtaacttcagaggatcttggcaaaacgtttagtgtggggaccggaaactgcacaactaatattctggaagctaagtactggtgtcccgacagcatggagtataactgccctaatttgtccccaagggaggaaccggatgacatagattgttggtgctacggcgtcgaaaacgtgcgggttgcatatggtaaatgtgactctgccgggcgctcgagaaggtcacggcgcgcgatcgatctccccacccacgagaatcatggactgaagacacgacaggagaaatggatgaccggcagaatgggcgaaaggcagctgcagaagattgagcggtggctcgtgcgtaaccctttctttgctgccactgcattagccatcgcttacctggtcgggagcaatatgacacaacgcgtggtaattgcacttttggttctggccgtgggaccagcttatagtgcccactgcatcggtataaccgacagagatttcatcgaaggcgtccatgggggaacgtgggtgtccgcgactctagagcaggacaagtgtgtgaccgtcatggcacccgataaaccttctctcgacattagcctggagacagttgccatcgatggcccagctgaagccaggaaggtgtgctactccgcagtacttactaacgtgaaaattaatgacaagtgtccctcaaccggtgaggctcacctggaagaggaaaacgagggggacaatgcctgcaaacggacatatagtgatcgaggatggggcaacggctgtgggttgtttggaaagggtagcatcgtcgcgtgcgccaagtttacctgcgcaaaatctatgtccctcttcgaggtggaccagacgaagatacagtacgttattcgcgctcaactgcatgtgggcgccaaacaggaaaattggaacactgatatcaagacattaaaattcgacgctctgtcagggagccaggaggccgaatttaccggatacggcaaggcaactctcgagtgtcaggtccaaacagccgtggatttcagtaactcttatattgctgaaagagagaaagagtcctggatcgtagacaagcagtgggcgcaggatcttaccctgccttggcaaagcggtagtgggggcgtttggagggaaatgcaccacttggtggagtttgaaccaccgcatgcagccacgatcaaggtcctagctctgggaaatcaggagggctctctcaaaaccgccctgacaggggcaatgcgggtgactaaggacaccaacaattccaaactttacaagctgcacggaggtcatgtcgcctgccgcgtgaaattgtcagctctcacactgaagggcacttcgtataagatgtgtaccgataaaatgagcttcgttaagaaccccacagacaccgggcacggaactgccgtgatgcaggtaaaagtccctaagggcgcaccatgcaggattcccgtgatggttgcggatgacttaacggctgccgtgaataaaggtatactggtcacagtgaaccctatcgcatccaccaatgacgatgaagtactaattgaggtgaacccaccctttggggactcttacatcatagttggcactggagatagcagactcacctatcagtggcacaaggagggctcaagtattgggaagctgttcacacaaaccatgaaaggagccgaacgtcttgctgtcatgggtgacgccgcatgggatttcggctccgctgggggatttttcactagcgtgggcaagggtatccatacagtgtttgggtctgccttccagggcttgtttggaggcctgtcatggatcacgaaagtcattatgggggttgtgctcatctgggtgggaattaatacccggaacatgactatgagtatgagcatgatactggtaggcgtcatcatgatgttcctttccctgggtgtgggggcggaccagggatgtgccattaattttggcaag

SEQ ID NO: 742 - RNA, 2091 nt, synthetic construct
  misc_feature 1..2091: note = derived and/or modified CDS sequence (opt3) from YFV__JF912185__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgtaaaaaccgatggctactcctgaatgtgacttcagaggatcttggcaagacgtttagtgtcgggaccggaaactgcacaactaatattctggaagccaaatactggtgtcccgacagcatggagtataactgccctaatttgtccccaagagaggaaccggatgacatagattgttggtgctacggcgtggaaaacgttagggtggcttatggtaagtgtgactctgcagggcggtcgcgcagatcaaggcgggccatcgatctccccacccacgagaatcatggactgaaaacacgccaggagaagtggatgaccggccgaatgggcgaaagacagctgcagaagattgagaggtggctcgtccggaaccctttctttgcggctactgccttagcaatcgcctacctggtggggagcaatatgacacaacgtgtagttattgctcttttggtgctggcagtcggaccagcctatagtgctcactgcatcggtataaccgaccgcgatttcatcgaaggcgtgcatgggggaacgtgggtgtccgccactctagagcaggacaaatgtgtcaccgttatggcgcccgataagccttctctcgacattagcctggagacagtggcaatcgatggcccagccgaagctagaaaagtatgctactccgccgtgcttactaacgtcaagattaatgacaaatgtccctcaaccggtgaggcacacctggaagaggaaaacgagggggacaatgcttgcaagaggacatatagtgatcggggatggggcaacggctgtgggttgtttggaaagggtagcatcgtggcctgcgcgaaatttacctgcgccaagtctatgtccctcttcgaggttgaccagacgaaaatacagtacgtgattcgagcacaactgcatgtcggcgctaagcaggaaaattggaacactgatatcaaaacattaaagttcgacgccctgtcagggagccaggaggctgaatttaccggatacggccgcgccactctcgagtgtcaggtgcaaacagcagtagatttcagtaactcttatattgccgaaatggagaaagagtcctggatcgttgacaagcagtgggctcaggatcttaccctgccttggcaaagcggtagtgggggcgtgtggagagaaatgcaccacttggtcgagtttgaaccaccgcatgcggcaacgatcaaggtgctagccctgggaaatcaggagggctctctcaaaaccgctctgacaggggccatgagggtcactaaggacaccaacaattccaaactttacaagctgcacggaggtcatgtggcatgccgggttaaattgtcagccctcacactgaagggcacttcgtataagatgtgtaccgataaaatgagcttcgtgaagaaccccacagacaccgggcacggaactgctgtaatgcaggtcaaagtgcctaagggcgccccatgccgcattcccgttatggtggcagatgacttaacggcggctgtcaataaaggtatactggtgacagtaaaccctatcgcctccaccaatgacgatgaagtgctaattgaggttaacccaccctttggggactcttacatcatagtcggcactggagatagcagactcacctatcagtggcacaaggagggctcaagtattgggaagctgttcacacaaaccatgaaaggagcagaaaggcttgccgtgatgggtgacgctgcctgggatttcggctccgcagggggatttttcactagcgtgggcaagggtatccatacagtctttgggtctgctttccagggcttgtttggaggcctgtcatggatcacgaaagttattatgggggtggtgctcatctgggtaggaattaatacccgtaacatgactatgagtatgagcatgatactggtcggcgtgatcatgatgttcctttccctgggtgttggggccgaccagggatgtgcgattaattttggcaag

SEQ ID NO: 743 - RNA, 2091 nt, synthetic construct
  misc_feature 1..2091: note = derived and/or modified CDS sequence (opt3) from YFV__JF912186__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgacgttcaagatggctactcctgaacgtgaccagtgaggatcttggcaaaacgtttagcgtcgggaccggaaattgcacaactaacattctggaagccaagtactggtgtcccgactccatggagtataattgccctaacttgtctccaagggaggaaccggatgacatagattgttggtgctacggcgtggaaaatgttcgggtggcttatggtaaatgtgactcggcagggcgctcaagaaggagccggcgcgccatcgatctccccacccacgagaaccatggactgaagacacgacaggagaaatggatgaccggcagaatgggcgaaaggcagctgcagaagattgagcggtggctcgtccgtaatcctttctttgcggctactgccttagcaatcgcctacctggtggggagtaacatgacacaacgcgtagttattgctcttttggtgctggcagtcggaccagcctattccgctcactgcatcggtataaccgacagagatttcatcgaaggcgtgcatgggggaacgtgggtgtctgccactctagagcaggacaagtgtgtcaccgttatggcgcccgataaacctagcctcgacatttccctggagacagtggcaatcgatggcccagccgaagctaggaaggtatgctactcagccgtgcttactaatgtcaaaattaacgacaagtgtcccagtaccggtgaggcacacctggaagaggaaaatgagggggacaacgcttgcaaacggacatatagcgatcgaggatggggcaatggctgtgggttgtttggaaagggttctatcgtggcctgcgcgaagttcacttgcgccaaatccatgtcactctttgaggttgaccagacgaagatacagtacgtgattcgcgcacaactgcatgtcggcgctaaacaggaaaactggaatactgatatcaagacattaaaattcgacgccctgagcgggagtcaggaggctgaatttaccggatacggcaaggccactctcgagtgtcaggtgcaaacagcagtagatttctctaactcctatattgccgaaatggagaaagagagctggatcgttgacaagcagtgggctcaggatcttaccctgccttggcaatcgggttctgggggcgtgtggagagaaatgcaccacttggtcgagtttgaaccaccgcatgcggcaacgatcaaggtgctagccctgggaaaccaggagggctccctcaaaaccgctctgacaggggccatgagggtcactaaggacaccaataactcaaaactttacaagctgcacggaggtcatgtggcatgccgggttaaattgagtgccctcacactgaagggcactagctataagatgtgtaccgataaaatgtccttcgtgaagaatcccacagacaccgggcacggaactgctgtaatgcaggtcaaagtgcctaagggcgccccatgccgcattcccgttatggtggcagatgacttaacggcggctgtcaacaaaggtatactggtgacagtaaatcctatcgcctctaccaacgacgatgaagtgctaattgaggttaatccaccctttggggacagctacatcatagtcggcactggagattcaagactcacctatcagtggcacaaggagggcagttccattgggaagctgttcacacaaaccatgaaaggagcagaaaggcttgccgtgatgggtgacgctgcctgggatttcggcagcgcagggggatttttcacttctgtgggcaagggtatccatacagtctttgggtcagctttccagggcttgtttggaggcctgagttggatcacgaaagttattatgggggtggtgctcatctgggtaggaattaacacccgtaatatgactatgagcatgtccatgatactggtcggcgtgatcatgatgttcctttctctgggtgttggggccgaccagggatgtgcgattaactttggcaag

SEQ ID NO: 744 - RNA, 2091 nt, synthetic construct
  misc_feature 1..2091: note = derived and/or modified CDS sequence (opt3) from YFV__JF912187__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgacgtaacagatggctactcctgaatgtgacttcagaggatcttggcaaaacgtttagtgtcgggaccggaaactgcacaactaatattctggaagccaagtactggtgtagcgactccatggagtataactgccccaatttgtctcctagggaggaaccagatgacatagattgttggtgctacggcgtggaaaacgttcgggtggcttatggtaaatgtgactcggcagggcgctcaagaaggagccggcgcgccatcgatctcccgacccacgagaatcatggactgaagacacgacaggagaaatggatgaccggcagaatgggcgaaaggcagctgcagaagattgagcggtggctcgtccgtaaccccttctttgcggctactgccttagcaatcgcctacctggtggggagtaatatgacacaacgcgtagttattgctcttttggtgctggcagtcggacctgcctattccgctcactgcatcggtataaccgacagagatttcatcgaaggcgtgcatgggggaacgtgggtgtctgccactctagagcaggacaagtgtgtcaccgttatggcgccagataaacccagcctcgacatttccctggagacagtggcaatcgatggccctgccgaagctaggaaggtatgctactcagccgtgcttactaacgtcaaaattaatgacaagtgtccaagtaccggtgaggcacacctggaagaggaaaacgagggggacaatgcttgcaaacggacatatagcgatcgaggatggggcaacggctgtgggttgtttggaaagggttctatcgtggcctgcgcgaagtttacctgcgccaaatccatgtcactcttcgaggttgaccagacgaagatacagtacgtgattcgcgcacaactgcatgtcggcgctaaacaggaaaattggaacactgatatcaagacattaaaattcgacgccctgagcgggagtcaggaggctgaatttaccggatacggcagagccactctcgagtgtcaggtgcaaacagcagtagatttctctaactcctatattgccgaaatggagaaggagagctggatcgttgacaaacagtgggctcaggatcttaccctgccctggcaatcgggttctgggggcgtgtggagggaaatgcaccacttggtcgagtttgaacctccacatgcggcaacgatcaaggtgctagccctgggaaatcaggagggctccctcaagaccgctctgacaggggccatgcgggtcactaaagacaccaacaattcaaaactttacaagctgcacggaggtcatgtggcatgccgcgttaagttgagtgccctcacactgaaaggcactagctataagatgtgtaccgataagatgtccttcgtgaaaaacccgacagacaccgggcacggaactgctgtaatgcaggtcaaggtgcccaaaggcgccccttgcaggattccagttatggtggcagatgacttaacggcggctgtcaataagggtatactggtgacagtaaaccccatcgcctctaccaatgacgatgaagtgctaattgaggttaaccctccatttggggacagctacatcatagtcggcactggagattcaagactcacctatcagtggcacaaagagggcagttccattgggaagctgttcacacaaaccatgaagggagcagaacgtcttgccgtgatgggtgacgctgcctgggatttcggcagcgcagggggatttttcacttctgtgggcaaaggtatccatacagtctttgggtcagctttccagggcttgtttggaggcctgagttggatcacgaaggttattatgggggtggtgctcatctgggtaggaattaatacccggaacatgactatgagcatgtccatgatactggtcggcgtgatcatgatgttcctttctctgggtgttggggccgaccagggatgtgcgattaattttggcaaa

SEQ ID NO: 745 - RNA, 2091 nt, synthetic construct
  misc_feature 1..2091: note = derived and/or modified CDS sequence (opt3) from YFV__JF912189__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgacgtaacagatggctactcctgaatgtgacttcagaggatcttggcaaaacgtttagtgtcgggaccggaaactgcacaactaatattctggaagccaagtactggtgtcccgacagcatggagtataactgccctaatttgtccccaagggaggaaccggatgacatagattgttggtgctacggcgtggaaaacgttcgggtggcttatggtaaatgtgactctgcagggcgctcgagaaggtcacggcgcgccatcgatctccccacccacgagaatcatggactgaagacacgacaggagaaatggatgaccggcagaatgggcgaaaggcagctgcagaagattgagcggtggctcgtccgtaaccctttctttgcggctactgccttagcaatcgcctacctggtggggagcaatatgacacaacgcgtagttattgctcttttggtgctggcagtcggaccagcctatagtgctcactgcatcggtataaccgacagagatttcatcgaaggcgtgcatgggggaacgtgggtgtccgccactctagagcaggacaagtgtgtcaccgttatggcgcccgataaaccttctctcgacattagcctggagacagtggcaatcgatggcccagccgaagctaggaaggtatgctactccgccgtgcttactaacgtcaaaattaatgacaagtgtccctcaaccggtgaggcacacctggaagaggaaaacgagggggacaatgcttgcaaacggacatatagtgatcgaggatggggcaacggctgtgggttgtttggaaagggtagcatcgtggcctgcgcgaagtttacctgcgccaaatctatgtccctcttcgaggttgaccagacgaagatacagtacgtgattcgcgcacaactgcatgtcggcgtgaaacaggaaaattggaacactgatatcaagacattaaaattcgacgctctgtcagggagccaggaggccgaatttaccggatacggcagagctactctcgagtgtcaggtacaaacagccgttgatttcagtaactcttatattgcagaaatggagaaggagtcctggatcgtggacaaacagtgggcccaggatcttaccctgccttggcaaagcggtagtgggggcgtctggagggaaatgcaccacttggtggagtttgaaccaccgcatgctgcgacgatcaaggtcctagcactgggaaatcaggagggctctctcaagaccgccctgacaggggctatgcgggtgactaaagacaccaacaattccaaactttacaaactgcacggaggtcatgttgcctgccgcgtgaagttgtcagcactcacactgaaaggcacttcgtataagatgtgtaccgataagatgagcttcgtaaagaaccccacagacaccgggcacggaactgccgtcatgcaagtgaaggttcctaaaggcgctccatgcaggattcccgtgatggtcgccgatgacttaacggcagcggtgaataagggtatactggtaacagtgaaccctatcgcttccaccaatgacgatgaagttctaattgaggtcaacccaccctttggggactcttacatcatagtgggcactggagatagcagactcacctatcagtggcacaaagagggctcaagtattgggaagctgttcacacagaccatgaagggagccgaacgtcttgcagtgatgggtgacgccgcttgggatttcggctccgccgggggatttttcactagcgtcggcaaaggtatccatacagtttttgggtctgcattccagggcttgtttggaggcctgtcatggatcacgaaggtgattatgggggtggtactcatctgggtcggaattaatacccggaacatgactatgagtatgagcatgatactggtgggcgttatcatgatgttcctttccctgggtgtgggggctgaccagggatgtgccattaattttggcaaa

SEQ ID NO: 746 - RNA, 2061 nt, synthetic construct
  misc_feature 1..2061: note = derived and/or modified CDS sequence (opt3) from YFV__AH005112__X-SS-prME-XX
  source 1..2061: mol_type = other RNA
atgagaggcctgagctccaggaagcggcgctctcacgacgtgctcaccgtccagttccttatcctggggatgttgttaatggccggaggtgttacactggtgcgtaaaaaccgatggctactcctgaatgtaacttcagaggatcttggcaagacgtttagtgtggggaccggaaactgcacaactaatattctggaagctaaatactggtgtcccgacagcatggagtataactgccctaatttgtccccaagagaggaaccggatgacatagattgttggtgctacggcgtcgaaaacgtgagggttgcatatggtaagtgtgactctgccgggcggtcgcgcagatcaaggcgggcgatcgatctccccacccatgagaatcacggactgaaaacacgccaagagaagtggatgaccggccgaatgggcgaaagacagctgcagaagattgagaggtggctcgtgcggaaccctttctttgctgtcactgccttaacaatcgcatacctggtggggagcaatatgacccagcgtgtagttattgcccttttggtgctggctgtcggaccagcatatagtgcccattgcatcggtataacggaccgcgatttcatcgaaggcgtgcacgggggaacttgggtgtccgctaccctagagcaagacaaatgtgtcacagttatggcccccgataagccttctctcgacattagcctggagactgtggcgatcgatggcccagcagaagccagaaaagtatgctacaacgctgtgcttacccatgtcaagattaatgacaaatgtccctccacaggtgaggcccacctggcagaagagaacgaaggggacaatgcttgcaagaggacctattcagatcggggatggggcaacggctgtgggttgtttggaaagggtagtatcgtggcctgcgcgaaattcacgtgcgccaagactatgagcctctttgaggttgaccagacaaaaatacagtacgtgattcgagcacagctgcacgtcggcgctaagcaagagaattggaacaccgatatcaaaactttaaagttcgacgccctgtctgggtcccaggaagctgagtttacaggatacggcaaagccaccctcgaatgtcaggtgcagacggcagtagatttcggtaactcatatattgccgagatggaaaaggagagctggatcgttgaccgccaatgggctcaggatcttaccctgccttggcagagtgggtctggcggagtgtggagagagatgcatcacttggtcgaatttgagccaccgcatgcggcaacaatcagggtgctagccctgggcaatcaagaagggtccctcaagactgctctgaccggagccatgcgggtcacaaaagacactaacgataataacctttacaagctgcacggtggccacgtgagctgccgcgttaaattgtcggcactcaccctgaaggggacatcttataaaatgtgtaccgacaagatgtccttcgtgaagaatcccactgatacgggacatggcacagtagtcatgcaagtgaaagttcctaagggtgccccatgcaaaattcccgtgatagtcgctgacgacttaaccgccgcaatcaacaaggggattctggtgactgtaaatcctatcgcgtcaaccaacgatgacgaggtgctaatagaagttaatccaccctttggcgatagttacattatcgtcggaacaggcgacagcagactcacctatcagtggcacaaagaggggtcctctatcggaaagctgttcactcagacaatgaggggtcaggagcgtcttgctgtgatgggcgatacggcctgggacttcagctcagcagggggatttttcaccagtattggcaagggtatccatactgtgtttgggtccgccttccagggcttgtttggaggcctgagctggattacaaaagtcataatgggggctgttctcatctgggtgggaattaacacccggaatatgacaatgtctatgtcaatgatcctggtgggcgtaatcatgatgttccttagtctgggtgtcggggcc

SEQ ID NO: 747 - RNA, 2091 nt, synthetic construct
  misc_feature 1..2091: note = derived and/or modified CDS sequence (opt3) from YFV__FJ654700__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaacaccgatatcaaaactctgaagtttgacgcattatccggctcacaggaagtagagttcacagggtacggaaaagctaccctggaatgtcaggttcagacggccgtggattttggcaacagctatattgctgagatggaaaccgagagttggatcgtcgacagacaatgggcccaggatctcacacttccttggcagtctggttccgggggcgtgtggagggagatgcatcacctggtcgaatttgagccaccgcatgcagtgactatccgggttttggccctaggaaatcaagaaggcagcctgaagaccgctctcacaggggcgatgcgcgtgactaaggacaccaacgataataacctgtacaaacttcacggaggtcacgtatcgtgcagagtcaagctgtctgcattgacactcaaaggcacctcctataagatttgtactgacaaaatgtttttcgtgaagaatcccacggatacagggcatggaaccgttgtgatgcaggtcaaggtgtcaaaaggcgccccttgcaggataccagtaatcgtggctgacgacctgactgccgcaattaacaagggtatcttagttaccgtcaatcccatagccagtacaaacgatgacgaggtgctgattgaagtgaatcctccattcggggatagctacatcatcgtcggccgtggagactcccggctaacctatcagtggcacaaagagggctctagcattgggaagctctttactcagacaatgaaaggagttgagcgactggctgtgatgggtgatacggcctgggacttctcaagtgcaggcgggtttttcacctccgtgggaaagggcatccatactgtatttggtagcgcgttccaagggctttttggcggattgaactggattacaaaggtcataatgggcgctgtgctgatctgggttgggattaataccagaaacatgacaatgtctatgtcaatgatcctcgtgggagtcatcatgatgttcctgagtcttggcgtgggtgccgatcaggggtgtgcaattaattttggaaaa

SEQ ID NO: 748 - RNA, 2091 nt, synthetic construct
  misc_feature 1..2091: note = derived and/or modified CDS sequence (opt3) from YFV__KM388817__X-SS-prME-XX
  source 1..2091: mol_type = other RNA
atgagaggcctgagctccaggaagcggcgctctcaggacgtgctcaccgtccaattccttatcctggggatgttgttaatggccggaggtgttacactggtgcgacgtaacagatggctactcctgaatgtaacttcagaggatcttggcaaaacgtttagtgtggggaccggaaactgcacaactaatattctggaagctaagtactggtgtcccgacagcatggagtataactgccctaatttgtccccaagggaggaaccggatgacatagattgttggtgctacggcgtcgaaaacgtgcgggttgcatatggtaaatgtgactctgccgggcgctcgagaaggtcacggcgcgcgatcgatctccccacccacgagaatcatggactgaagacacgacaggagaaatggatgaccggcagaatgggcgaaaggcagctgcagaagattgagcggtggctcgtgcgtaaccctttctttgctgccactgcattaacaatcgcctacctggtcgggagcaatatgacccaacgcgtggtaattgctcttttggttctggcagtgggaccagcctatagtgctcactgcatcggtataacggacagagatttcatcgaaggcgtccatgggggaacttgggtgtccgccaccctagagcaggacaagtgtgtgacagtcatggcgcccgataaaccttctctcgacattagcctggagactgttgcaatcgatggcccagccgaagctaggaaggtgtgctactccgccgtacttaccaacgtgaaaattaatgacaagtgtccctcaacaggtgaggcacacctggaagaggaaaacgagggggacaatgcttgcaaacggacctatagtgatcgaggatggggcaacggctgtgggttgtttggaaagggtagcatcgtcgcctgcgcgaagttcacgtgcgccaaatctatgtccctctttgaggtggaccagactaagatacagtacgttattcgcgcacaactgcatgtgggcgctaaacaggaaaattggaacacagatatcaagaccttaaaattcgacgccctgtcagggagccaggaggctgaatttactggatacggcagagccacactcgagtgtcaggtccaaaccgcagtggatttcagtaactcttatattgccgaaatggagaaggagtcctggatcgtagacaaacagtgggctcaggatcttacgctgccttggcaaagcggttctgggggcgtttggagggaaatgcaccacttggtggagtttgaaccaccgcatgcggcaaccatcaaggtcctagccctgggaaatcaggagggctcgctcaagacagctctgactggggccatgcgggtgaccaaagacacaaacaattccaaactttacaagctgcacggaggtcatgtcgcatgccgcgtgaagttgtcagccctcactctgaaaggcaccagttataagatgtgtacagataagatgagcttcgttaaaaaccccaccgacactgggcacggaacggctgtgatgcaggtaaaggtccctaaaggcgccccatgcaggattcccgtgatggttgcagatgacttaacagcggctgtgaataagggtatactggtcaccgtgaaccctatcgcctccactaatgacgatgaagtactaattgaggtgaacccaccctttggggactcttacatcatagttggcaccggagatagcagactcacatatcagtggcacaaagagggctcaagtattgggaagctgttcacccaaactatgaagggagcagaacgtcttgccgtcatgggtgacgctgcctgggatttcggctccgcagggggatttttcacaagcgtgggcaaaggtatccatacggtgtttgggtctgctttccagggcttgtttggaggcctgtcatggatcaccaaggtcattatgggggttgtgctcatctgggtgggaattaatactcggaacatgacaatgagtatgagcatgatactggtaggcgtcatcatgatgttcctttccctgggtgtgggggccgaccagggatgtgcgattaattttggcaaa

SEQ ID NO: 749 - RNA, 2091 nt, synthetic construct
  misc_feature 1..2091: note = derived and/or modified CDS sequence (opt3) from YFV__HM582851__X-SS-prME-XX
  source 1..2091: mol_type = other RNA
atgagaggcctgagctccaggaagcggcgctctcaggacgtgctcaccgtccaattccttatcctggggatgttgttaatggttggaggtgtgacactggtacgacgtaacagatggctactcctgaatgtgacttcagaggatcttggcaaaacgtttagtgtcgggaccggaaactgcacaactaatattctggaagccaagtactggtgtcccgacagcatggagtataactgccctaatttgtccccaagggaggaaccggatgacatagattgttggtgctacggcgtggaaaacgttcgggtggcttatggtaaatgtgactctgcagggcgctcgagaaggtcacggcgcgccatcgatctccccacccacgagaatcatggactgaagacacgacaggagaaatggatgaccggcagaatgggcgaaaggcagctgcagaagattgagcggtggctcgtccgtaaccctttctttgcggctactgccttagcaatcgcctacctggtggggagcaatatgacacaacgcgtagttattgctcttttggtgctggcagtcggaccagcctatagtgctcactgcatcggtataaccgacagagatttcatcgaaggcgtgcatgggggaacgtgggtgtccgccactctagagcaggacaagtgtgtcaccgttatggcgcccgataaaccttctctcgacattagcctggagacagtggcaatcgatggcccagccgaagctaggaaggtatgctactccgccgtgcttactaacgtcaaaattaatgacaagtgtccctcaaccggtgaggcacacctggaagaggaaaacgagggggacaatgcttgcaaacggacatatagtgatcgaggatggggcaacggctgtgggttgtttggaaagggtagcatcgtggcctgcgcgaagtttacctgcgccaaatctatgtccctcttcgaggttgaccagacgaagatacagtacgtgattcgcgcacaactgcatgtcggcgctaaacaggaaaattggaacactgatatcaagacattaaaattcgacgccctgtcagggagccaggaggctgaatttaccggatacggcagagccactctcgagtgtcaggtgcaaacagcagtagatttcagtaactcttatattgccgaaatggagaaggagtcctggatcgttgacaaacagtgggctcaggatcttaccctgccttggcaaagcggtagtgggggcgtgtggagggaaatgcaccacttggtcgagtttgaaccaccgcatgcggcaacgatcaaggtgctagccctgggaaatcaggagggctctctcaagaccgctctgacaggggccatgcgggtcactaaagacaccaacaattccaaactttacaagctgcacggaggtcatgtggcatgccgcgttaagttgtcagccctcacactgaaaggcacttcgtataagatgtgtaccgataagatgagcttcgtgaaaaaccccacagacaccgggcacggaactgctgtaatgcaggtcaaggtgcctaaaggcgccccatgcaggattcccgttatggtggcagatgacttaacggcggctgtcaataagggtatactggtgacagtaaaccctatcgcctccaccaatgacgatgaagtgctaattgaggttaacccaccctttggggactcttacatcatagtcggcactggagatagcagactcacctatcagtggcacaaagagggctcaagtattgggaagctgttcacacaaaccatgaagggagcagaacgtcttgccgtgatgggtgacgctgcctgggatttcggctccgcagggggatttttcactagcgtgggcaaaggtatccatacagtctttgggtctgctttccagggcttgtttggaggcctgtcatggatcacgaaggttattatgggggtggtgctcatctgggtaggaattaatacccggaacatgactatgagtatgagcatgatactggtcggcgtgatcatgatgttcctttccctgggtgttggggccgaccagggatgtgcgattaattttggcaaa

SEQ ID NO: 750 - RNA, 2091 nt, synthetic construct
  misc_feature 1..2091: note = derived and/or modified CDS sequence (opt3) from YFV__JN620362__X-SS-prME-XX
  source 1..2091: mol_type = other RNA
atgagaggcctgagctccaggaagcggcgctctaacgagatgaccatgatgcccctccttatcctgtcaatggtgattttggccgggggagtcacattagttcgaaagaatcgttggctgctactcaacgtgactgctgaagacctgggtaagacgttcagtgtaggcaccgggaattgcacaactaacatacttgaggcaaaatactggtgtcctgatagcatggaatataattgcccaaacctgtccccgagagaggaacccgacgatatcgactgttggtgctacggagtggagaatgtcagggtggcctatggccggtgtgatgcggttggtcgctctaagagatcgaggcgggctattgacttgcctacccacgagaaccatgggctcaaaacacgccaggaaaagtggatgaccggacgaatgggcgagagacaactgcagaagatcgaaaggtggctggtgcggaatccatttttcgccattactgcactcgccatcgcttacttagtcggcaacaatatgacacagcgtgtggtaatagcactgcttgttttggccgtggggcccgcttattcagcccactgcatcggaattaccgatcgcgactttatcgagggtgtccatggcgggacgtgggtgagcgcgactctggagcaggataaatgtgtgaccgtcatggcacctgacaagccaagtctagatatttccctccaaacagttgccatcgacggacccgctgaagccagaaaagtgtgctactctgcagtactgactcacgtgaagataaacgataaatgtcctagcaccggcgaggctcatcttgccgaagagaatgacggtgacaacgcgtgcaagaggacatattccgatcgggggtggggaaatggctgtggcctgttcgggaagggatcaattgtcgcctgcgcaaaatttacctgcgctaagagtatgagcttgttcgaagtggaccagacgaaaatccagtacgttattcgagcccagctccacgtgggtgctaagcaagagaactggaacactgatatcaaaacactgaagtttgacgccttatctggctcccaggaggcagagttcaccgggtacggaaaagccactctggaatgtcaggtccagacagctgtggattttggcaattcatatatcgcggaaatggagaaggacagctggattgtagatcgccaatgggcacaggacctcacccttccatggcagagtggttctgggggcatatggagagaaatgcaccatctggttgagttcgagccgccccacgccgctacgatcagggtgttggccctaggaaaccaagaaggctccctgaagaccgcactcacaggggccatgcgggtcactaaagatgagaatgacaacaatctgtacaaacttcatggaggtcacgtgagctgccgcgtcaaactgtcggctttgaccctcaagggcacatcttataaaatgtgtactgataagatgtcctttgtgaagaaccctaccgacacagggcacggaaccgttgtgatgcaggtaaaagtcccaaagggcgccccctgcaaaattcctgtgatcgttgcagacgatctgactgcggctgtgaataagggtatattagtcacggtgaacccaattgcctcaacaaatgacgatgaagtactgatcgaggtgaatcccccgttcggggacagttacatcattgttggcaccggagatagcagactaacttatcagtggcataaagaaggctcctctatcgggaagctctttacccagacaatgaagggagcagagaggctggccgtcatgggtgacgctgcctgggatttcagctcagcaggcgggttctttaccagtgtgggaaaaggcattcacactgtgttcggttccgcttttcaagggcttttcggcggattgagctggataacaaaggtcatcatgggcgccgttctgatttgggtggggatcaacacgcgtaacatgaccatgtctatgtcaatgatcctcgtgggagtaattatgatgtttctgagtcttggcgtcggtgcggaccaggggtgtgccgtgaatttcggaaaa

SEQ ID NO: 751 - RNA, 2091 nt, synthetic construct
  misc_feature 1..2091: note = derived and/or modified CDS sequence (opt3) from YFV__JN811142__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgaaagaaccgttggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaccactgatatcaaaacactgagatttgacgcattatccggctcacaggaagtagagttcattgggtacggaaaggctaccctggaatgtcaggttcagacggccgtggattttggcaacagctatatcgctgagatggaaaccgagagttggatcgtcgacaggcaatgggcccaggatctcacacttccttggcagtctggttccgggggcgtgtggcgggagatgcatcacctggtcgaatttgagccaccgcatgcagccactattcgcgtgttggctctaggaaaccaagaaggcagcctgaaaaccgcgctcacaggggcaatgagagttactaaggacaccaatgataacaatctgtacaaacttcacggaggtcacgtgtcgtgcagggtaaaactgtctgccttgacactcaagggcacctcctataaaatatgtactgacaagatgtttttcgtcaaaaaccccacggatacagggcatggaaccgtggttatgcaagtgaaggtctcaaagggcgctccttgccgtatcccagtgattgtagccgacgacctgactgcagccatcaataaaggtatattagtgaccgttaaccccattgctagtacaaatgatgacgaggtcctgatcgaagtgaaccctccattcggggatagctacatcattgtgggccggggagactcccgactaacctatcagtggcacaaggagggctctagcatcgggaaactctttactcagacaatgaagggagtcgagagactggccgttatgggtgatacggcatgggacttctcaagtgcgggcgggtttttcacctccgtgggaaaaggcattcatactgtgtttggtagcgctttccaggggctttttggcggattgaattggataacaaaggtaatcatgggcgccgtcctgatttgggtggggatcaacaccaggaatatgacaatgtctatgtcaatgatcctcgttggagtgattatgatgttcctgagtcttggcgtcggtgcagatcaggggtgtgccataaactttggaaag

SEQ ID NO: 752 - RNA, 2091 nt, synthetic construct
  misc_feature 1..2091: note = derived and/or modified CDS sequence (opt3) from YFV__DQ100292__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgaaagaaccgttggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagcaaggaaagtatgctacaacgccgtgctgacacatgtcaagattaatgacaaatgtccctccaccggcgaggctcaccttgccgaagagaacgaaggtgacaatgcatgcaagcggacgtattcagatcgagggtggggaaacggctgtggcctgttcgggaagggaagtatcgtggcttgcgccaaatttacttgcgcgaaaagcatgtctttgttcgaggttgaccagacaaaaatacagtacgtgattcgcgcccagctccacgtcggtgcaaagcaagagaattggaacaccgatatcaaaactctgaagtttgacgctttatccggctcacaggaagtggagttcattgggtacggaaaagccacactggaatgtcaggtacagaccgctgttgattttggcaacagctatatcgccgagatggaaacggagagttggatcgtggacagacaatgggcacaggatctcacccttccttggcagtctggttccgggggcgtctggagggagatgcatcacctggtggaatttgagccaccgcatgccgctacaattcgggtcttggcgctaggaaatcaagaaggcagcctgaagactgcactcaccggggccatgcgcgtgacaaaggacactaacgataataacctgtacaaacttcacggaggtcacgtttcgtgcagagtgaagctgtctgctttgaccctcaaaggcacatcctataagatatgtaccgacaaaatgtttttcgtaaagaatcccactgatacggggcatggaacagtcgtgatgcaggttaaggtgcctaaaggcgccccatgcaggatccccgtcattgtggcagacgacctgaccgccgctgtaaacaagggtatcttagtgactgttaatcctatagcctcaaccaacgatgacgaggtcctgattgaagtgaatccacccttcggggatagttacatcatcgtgggccgtggagacagccggctaacatatcagtggcacaaagagggctcctctattgggaagctctttacccagactatgaaaggagtcgagcgactggcagttatgggtgatacagcgtgggacttcagctcagctggcgggtttttcacgagtgtgggaaagggcatccataccgtgtttggttccgccttccaagggctttttggcggattgaactggattactaaggtaataatgggcgcagtcctgatctgggtggggattaatacaagaaacatgaccatgagcatgtctatgatcctcgttggagtgatcatgatgttcctgtcacttggcgtcggtgccgatcaggggtgtgctattaattttggaaaa

SEQ ID NO: 753 - RNA, 2091 nt, synthetic construct; identical to SEQ ID NO: 216
  misc_feature 1..2091: note = derived and/or modified CDS sequence (opt3) from YFV__DQ118157__X-SS-prME-XX
  source 1..2091: mol_type = other RNA

SEQ ID NO: 754 - RNA, 2091 nt, synthetic construct
  misc_feature 1..2091: note = derived and/or modified CDS sequence (opt3) from YFV__DQ235229__X-SS-prME-XX
  source 1..2091: mol_type = other RNA
atgatcggcctgagctccagaaagaggcggtctaacgagatggccatgatgcccctccttattctgtcaatggtgatattggctgggggagtcaccttagttcgcaaaaatcgatggctgctactcaacgtgacagcagaagacctgggtaagactttcagtcttggcacggggaattgcaccacaaacatcctggaggccaaatactggtgtcctgatagcatggaatataattgcccaaacttgtccccgcgtgaggaacccgacgatattgactgttggtgctacggagtagagaatgtgagagtcgcgtatggtaggtgtgatgctgtgggccggtctaagcgctcgagaagggccatcgacctccctactcacgagaaccatgggctgaaaacccggcaggaaaagtggatggcaggacgcatgggcgagcgacaactgcagaagattgaaagatggctcgttaggaatccatttttcgccatcacagctttagcaatagcctacctggtgggcaacaatatgacccagcgggtcgtgatcgctcttttggtactggccgttgggcccgcgtattcagcacactgcattggaatcactgatcgtgactttattgagggtgtgcatggcgggacatgggtcagcgccaccctagagcagggaaaatgtgtgacggtgatggctcctgataagccaagtctcgacatctccctgcaaactgtcgccatagatggccccgcagaagctcgcaaagtttgctactctgccgtgcttacccacgtaaagattaacgacaaatgtcctagcacaggtgaggcgcatctggccgaagagaatgatggggacaacgcatgcaagagaacttattccgacaggggatggggcaatggctgtgggttgttcggaaagggttcaatcgtggcttgcgccaaatttacctgcgctaagagtatgagcctcttcgaagtcgatcagacaaaaattcagtacgtgatccgggcccagctgcacgttggcgcaaagcaagagaactggaacaccgacatcaaaacgttaaagtttgatgccctgtctgggtcccaggaggctgagttcactggatacggcaaagcgacactcgaatgtcaggtgcagaccgcagtcgactttggtaattcatatattgccgaaatggagaaggatagctggatagtggaccgacaatgggctcaggatcttactctgccatggcagagtgggtctggcggaatctggcgcgaaatgcaccatttggtagagttcgagccgccccacgccgcaacaattagagttctagccctgggcaaccaagaagggtccctcaagaccgctctgacgggagccatgagggtgaccaaagacgagaatgataacaatctttacaagctgcatggtggccacgtcagctgccgggtgaaattgtcggcactcacactgaaggggacttcttataaaatgtgtaccgacaagatgtcctttgtcaagaaccctacagatactggacacggcaccgtggttatgcaagtgaaagtaccaaagggtgcgccctgcaaaatccctgtcatagtggctgacgacttaacagccgcagttaataaggggattctggtgaccgtcaacccaatcgcctcaactaatgatgacgaagtgctaatcgaggtaaatcccccgttcggcgatagttacattatcgtgggaacgggcgacagccgcctcacatatcagtggcataaagaagggtcctctattggaaagctgtttacccagactatgaagggtgctgagagacttgccgttatgggcgatgcagcttgggacttcagctcagccgggggattctttaccagtgtcggcaaaggtatacacacagtgttcgggtccgcgtttcagggcttgttcggaggcctgagctggatcaccaaggtgattatgggggccgtcctcatctgggttggaatcaacactaggaacatgacaatgtctatgtcaatgattctggtgggcgtgataatgatgtttcttagtctgggtgtaggggctgatcagggatgtgcagtcaatttcggcaaa

SEQ ID NO: 755 - RNA, 2088 nt, synthetic construct
  misc_feature 1..2088: note = derived and/or modified CDS sequence (opt3) from YFV__DQ322633__X-SS-prME-XX
  source 1..2088: mol_type = other RNA
atgggcctgagctccagaaagaggcggtctcacgacgtgctcaccgtccagttccttatcctggggatgttgttaatgacaggaggtgttactctggtgcgcaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccacgtgaggaaccggatgacatagattgttggtgctacggcgtcgaaaacgtgagagttgcttatggtaagtgtgactctgcagggaggtcgcggcgctcaagaagggccatcgatctccccacacatgagaatcacggactgaaaacccggcaagagaagtggatgactggccgcatgggcgaacgacagctgcagaagattgagagatggttcgtgaggaaccctttcttcgcggtcacagctctcaccatcgcctacttagtggggagcaatatgacgcagcgggtagttattgcactgcttgtgttggccgtcggaccagcttatagtgcacattgcatcggtataactgaccgtgattttatcgaaggcgtgcacgggggaacctgggtgtccgccacactggagcaagacaaatgtgtcactgttatggctcccgataagccttctctagacattagcctcgagaccgtggccatcgatcgcccagcggaagtaagaaaagtgtgctacaacgcagtcctgacacatgtgaagattaatgacaaatgtccctccaccggcgaggcccaccttgctgaagagaacgaaggtgacaatgcctgcaagaggacgtattcagatcgggggtggggaaacggctgtggcctgttcgggaagggaagtatcgttgcatgcgctaaatttacttgcgccaagagcatgtctttgttcgaggtggaccagacaaaaatacagtacgtcattcgagcgcagctccacgtgggtgccaagcaagagaattggaacaccgatatcaaaactctgaagtttgacgcattatccggctcacaggaagtagagttcattgggtacggaaaagctacactggaatgtcaggttcagaccgccgtggattttggcaacagctatatcgctgagatggaaacggagagttggatcgtcgaccgccaatgggcccaggatctcacccttccttggcagtctggttccgggggcgtgtggagagagatgcatcacctggtcgaatttgagccaccgcatgcagccacaattagggtgttggctctaggaaatcaagaaggcagcctgaagactgcgctcaccggggcaatgcgggttacaaaggacactaacgataataacctgtacaaacttcacggaggtcacgtgtcgtgccgcgtaaagctgtctgccttgaccctcaaaggcacatcctataagatatgtaccgacaaaatgtttttcgtcaagaatcccactgatacggggcatggaacagtggttatgcaagtgaaggtctcaaaaggcgctccttgcagaatcccagtgattgtagccgacgacctgaccgcagccatcaacaagggtatattagtgactgttaatcccattgctagtaccaacgatgacgaggtcctgatcgaagtgaatcctccattcggggatagctacatcattgtgggcaggggagactcccgtctaacatatcagtggcacaaagagggctctagcatcgggaagctctttacccagactatgaaaggagtcgagcggctggccgttatgggtgatacagcatgggacttctcaagtgcgggcgggtttttcacgtccgtgggaaagggcattcataccgtgtttggtagcgctttccaggggctttttggcggattgaactggataactaaggtaatcatgggcgccgtcctgatttgggtggggatcaatacacgaaacatgaccatgtctatgtcaatgatcctcgttggagtgattatgatgttcctgagtcttggcgtcggtgcagatcaggggtgtgccataaattttggaaaa

SEQ ID NO: 756 - RNA, 2067 nt, synthetic construct
  misc_feature 1..2067: note = derived and/or modified CDS sequence (opt3) from YFV__DQ322634__X-SS-prME-XX
  source 1..2067: mol_type = other RNA
atgagaagccacgacgtgctgaccgtccagttcctcatccttggcatgctgttgatgacagggggagttactttagtgaggaagaaccggtggctgctactcaatgtaacgtccgaggatctgggtaaaaccttttctgtgggcacagggaactgcactaccaatattcttgaagccaagtactggtgtcccgactcaatggagtataactgccctaatctgagtccacgcgaggaaccggatgacatagattgttggtgctacggagtcgaaaacgtgcgagttgcttatggcaaatgtgacagcgcaggtcgttccagaaggtctcggcgcgccatcgatttgcccacacatgagaatcacgggctcaagaccagacaagagaaatggatgactggaaggatgggcgaacggcagctgcagaagattgagcgctggttcgtgcgaaaccctttcttcgcggtcacagctctgaccatcgcctacctcgtgggctcgaatatgacgcagagagtagttattgcattactggtgcttgccgtcgggccagcttattcagcacattgcatcggaataactgacagggattttatcgaaggtgtgcacggcgggacctgggtgagcgccacattggagcaagacaagtgtgtcactgttatggctcccgataaacctagtctggacatttccctagagaccgtggccatcgatcggccagcggaagtacgtaaggtgtgctacaacgcagtcctcacacatgtgaaaattaatgacaagtgtccctctaccggagaggcccacctggctgaagagaacgaaggcgacaatgcctgcaaacgcacgtatagcgatagaggttgggggaacggatgtggccttttcggcaaggggtccatcgttgcatgcgctaagtttacttgcgccaaatcaatgagtctgttcgaggtggaccagacaaagatacagtacgtcattagggcgcagttgcacgtgggagccaaacaagagaattggaacaccgatatcaagactctcaaatttgacgcactgagcggttctcaggaagtagagttcattggctacgggaaggctacattagaatgtcaggttcagaccgccgtggattttggaaactcctatatcgctgagatggaaacggagtcatggatcgtcgaccggcaatgggcccaggatctgaccctcccttggcagagcggcagtggtggggtgtggcgagagatgcatcaccttgtcgaatttgagccaccgcatgcagccacaattcgcgtgctggctttgggcaatcaagaaggatctctaaaaactgcgctgaccggcgcaatgagagttacaaaggacactaacgataataacctctacaagctgcacgggggacacgtgtcctgcagggtaaaacttagcgccctgaccttgaagggtacatcgtataaaatatgtaccgacaagatgtttttcgtcaaaaatcccactgatacgggccatgggacagtggttatgcaagtgaaggtctctaagggagctccttgccggatcccagtgattgtagccgacgacctcaccgcagccatcaacaaaggcatactggtgactgttaatcccattgcttccaccaacgatgacgaggtcttaatcgaagtgaatcctccattcggtgattcatacatcattgtggggcgcggcgacagtagactgacatatcagtggcacaaggagggaagctccatcggcaaactatttacccagactatgaagggggtcgagaggctcgccgttatgggagatacagcatgggacttctctagcgcgggtggctttttcacgtcagtggggaaaggcattcataccgtgtttggaagtgctttccagggtctgtttgggggccttaactggataactaaggtaatcatgggagccgtcttgatttgggtgggcatcaatacacgtaacatgaccatgtccatgagcatgatcctggttggggtgattatgatgttcctctctctgggagtcggcgcagatcagggttgtgccataaattttgggaag

SEQ ID NO: 757 - RNA, 2061 nt, synthetic construct
  misc_feature 1..2061: note = derived and/or modified CDS sequence (opt3) from YFV__DQ322642__X-SS-prME-XX
  source 1..2061: mol_type = other RNA
atgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaacaccgatatcaaaactctgaagtttgacgcattatccggctcacaggaagtagagttcattgggtacggaaaagctacactggaatgtcaggttcagaccgccgtggattttggcaacagctatatcgctgagatggaaacggagagttggatcgtcgacagacaatgggcccaggatctcacccttccttggcagtctggttccgggggcgtgtggagggagatgcatcacctggtcgaatttgagccaccgcatgcagccacaattcgggtgttggctctaggaaatcaagaaggcagcctgaagactgcgctcaccggggcaatgcgcgttacaaaggacactaacgataataacctgtacaaacttcacggaggtcacgtgtcgtgcagagtaaagctgtctgccttgaccctcaaaggcacatcctataagatatgtaccgacaaaatgtttttcgtcaagaatcccactgatacggggcatggaacagtggttatgcaagtgaaggtctcaaaaggcgctccttgcaggatcccagtgattgtagccgacgacctgaccgcagccatcaacaagggtatattagtgactgttaatcccattgctagtaccaacgatgacgaggtcctgatcgaagtgaatcctccattcggggatagctacatcattgtgggccgtggagactcccggctaacatatcagtggcacaaagagggctctagcatcgggaagctctttacccagactatgaaaggagtcgagcgactggccgttatgggtgatacagcatgggacttctcaagtgcgggcgggtttttcacgtccgtgggaaagggcattcataccgtgtttggtagcgctttccaggggctttttggcggattgaactggataactaaggtaatcatgggcgccgtcctgatttgggtggggatcaatacaagaaacatgaccatgtctatgtcaatgatcctcgttggagtgattatgatgttcctgagtcttggcgtcggtgca

SEQ ID NO: 758 - RNA, 2091 nt, synthetic construct
  misc_feature 1..2091: note = derived and/or modified CDS sequence (opt3) from YFV__GQ379162__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgaaagaaccgttggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagcaaggaaagtatgctacaacgccgtgctgacacatgtcaagattaatgacaaatgtccctccaccggcgaggctcaccttgccgaagagaacgaaggtgacaatgcatgcaagcggacgtattcagatcgagggtggggaaacggctgtggcctgttcgggaagggaagtatcgtggcttgcgccaaatttacttgcgcgaaaagcatgtctttgttcgaggttgaccagacaaaaatacagtacgtgattcgcgcccagctccacgtcggtgcaaagcaagagaattggaacacctccatcaaaactctgaagtttgatgctttatcaggcagccaggaagtggagttcattgggtacggaaaagccacactggaatgtcaggtacagaccgctgttgactttggcaacagttatatcgccgagatggaaacggagtcttggatcgtggatagacaatgggcacaggacctcacccttccttggcagtccggtagcgggggcgtctggagggagatgcatcacctggtggaatttgagccaccgcatgccgctacaattcgggtcttggcgctaggaaatcaagaaggctcgctgaagactgcactcaccggggccatgcgcgtgacaaaggatactaacgacaataacctgtacaaacttcacggaggtcacgtttcttgcagagtgaagctgtccgctttgaccctcaaaggcacatcatataagatatgtaccgataaaatgtttttcgtaaagaatcccactgacacggggcatggaacagtcgtgatgcaggttaaggtgcctaaaggcgccccatgcaggatccccgtcattgtggcagatgacctgaccgccgctatcaacaagggtatattagtaactgtgaatcctattgccagtaccaacgacgatgaggttctgatcgaagtcaatccacccttcggggacagctacatcattgtgggccgtggagattcccggctaacatatcagtggcacaaagagggctctagcatcgggaagctctttacccagactatgaaaggagtggagcgactggcagtcatgggtgacgttgcgtgggatttctcaagtgctggcgggtttttcacatccgtgggaaagggcattcatacggtgtttggtagcgccttccaagggctttttggcggattgaactggataaccaaggtaatcatgggcgcagtcctgatttgggtggggatcaatactagaaacatgacaatgtctatgtcaatgatcctcgttggagtgattatgatgttcctgagtcttggcgtcggtgccgaccaggggtgtgctataaattttggaaaa

SEQ ID NO: 759 - RNA, 2085 nt, synthetic construct
  misc_feature 1..2085: note = derived and/or modified CDS sequence (opt3) from YFV__DQ859065__X-SS-prME-XX
  source 1..2085: mol_type = other RNA
atgctgaagggcgtgagcgggagaaagaagaggcggtccgtcgaggccaccggattcgtttctacactcctttttggtatcgtgctgactgcttcagtaagtcgccacgcacatcacacgttgttaaacgtgaccaaagaagacacaaatcagattctgactctacgaaacggcaattgcaccgtcgtgagcatggatgttgggtcctggtgtgacgataacgtggagtacgactgcgtcacactccaagataatgaagaacccgacgatgtggactgttggtgctataaggtaaacggagttcgtgtgacctacggcaaatgtagagaaggtaatactcctaggcggtctaagcgcgccgtcgtgataacagcgcatctggatcaggggcttaccacgaagaaagagacttggctgggatcgtcacacttcgagacccagatccagaagattgaaaaatggatcattagaaacccaacatatgctatcgccgcaataatcatggcctggtacattggcaatagcactaagcaaagggtggtcttgctcctgctgaccctcgctttaggcccggcatatgccacacattgcgttgggatcgctaaacgggactttgtgcagggagtacagggtaccacgtgggtgaacgtcgtgatggagcagggcgcctgtgttactattgtgacagaagggaagcccagtgtcgatgtgtggatggagggaatcaccttctcctctcctactatggtacgccgaataagccacacagcgaccatttccgacacgaagatctcaagtgcatgcccaagcaccggcgaggccaaactggatgaggagcacgacaagacatttgaatgtaaaagaacttactctgacaggggttgggggaatggatgcggccttttcggcaaggggtccattgttgcttgtgccaaatttacctcaacaggacatatggatgtgtatgagatggacatgactaaggtcgaatacaccatcaaaacacaagtgcacagcggtgcaaagagtgatgacaccactggcgtcaaggagatcaaattcacgcccgtgtctgggacacagaccgttgagtttcctggatacggcaacttgggtctggaatgcattgtgcagtccgatatagacttcactacccattatctagtagtcctcgggacagatgcttggctggtgcacaaggcctgggttgaggacgtgacccttccatggaaacacgaaggcgcggccagctggcgggataagcagtacctggtcgagtttggagaaccccatgcagctactatcaaagtgttggtactcggctcgcaagagggggccctgcgtacagctttagccggagcaatgatggtgacgcacgactcttccgccaagaccttcaagctgcatggtggccacgttacttgcaaagctaagctcaatgatcttgtcattaaagggacaacctatacaaactgtcgcggaggcctgtcatttgtgaagactcctaccgacacgggtcatgggaccgtggtcatgcaggttaaagtgagtagaaatgcgccatgcaggttgacagtgatcgcagccgacgatgctagcggccacgtaaaccggggaactctagtcacctccaacccgatagccaattctaacaatgacgaggtgctggttgaagtgaatcccccttacggcagctcatatctcattgtcgggacaggagatgacaagctggtgtaccagtggaagaaaagtggttccagcatcggcaaacttttctctgagactgttaaaggggcacaacgaatggccatcgtgggatcaagtagctgggatttctcctctgctggcgggtttttctcgagcgtaggtaaggccctgcacaccgtctttggcacggcattccagggaatttttggcgggttgtcctggatcacacgcgtgctcattggagtgctgttaatatggctgggcctaaactcaagaaacggtatggcgaccactgtcatgatgatcacagggttcgttattctctttctgagtcttggagtgggcgctgaaatcggttgttctgtaaattggggccag

SEQ ID NO: 760 - RNA, 2091 nt, synthetic construct
  misc_feature 1..2091: note = derived and/or modified CDS sequence (opt3) from YFV__KU921608__X-SS-prME-XX
  source 1..2091: mol_type = other RNA
atgagaggcctggccagcaggaagcggcgctccaacgagatggctctcttcccccttctgttgttagggctgctagcactctctggaggtgtgaccctggtccgtaaaaatcgatggcttctgttgaacgttacagccgaagacctcggcaagactttttcagtggggacgggaaattgcaccacaaacatcctggaggcgaaatactggtgtcctgatagtatggaatataattgcccaaacctgagcccgagagaggaacccgacgatattgactgttggtgctacggcgtagagaatgtgagggtcgcttatggtcggtgtgatgccgtggggcgctccaagagatctaggcgggcaatagacctccctactcacgagaaccatggattaaaaacccgccaggaaaagtggatgacaggccgaatgggcgagagacaactgcagaagatcgaaaggtggcttgttcggaatccattctttgccgtgaccgctttggcaattgcctacctggtcgggaacaatactacacagcgtgtggtaatcgctctactcgttctggccgtgggacccgcgtattcggcacactgcattggtatcaccgatcgcgacttcatagagggcgtccatgggggaacgtgggtgtcagccactcttgagcaggataaatgtgtgaccgtcatggctcctgacaagccaagcctggatatcagtttgcaaacagttgccattgacggccccgcagaagctagaaaagtgtgctactccgccgtactcactcacgtgaagatcaacgataaatgtccttctaccggtgaggcgcatctggccgaagagaatgacggggacaacgcatgcaagaggacatatagcgatcggggatggggcaatggctgtgggttatttggaaagggttccattgtcgcttgcgccaaatttacctgcgctaagtcaatgagtctgttcgaagtggaccagacgaaaatccagtacgttatacgagcccagctccacgtgggcgcaaagcaagagaactggaacactgatattaaaacacttaagttcgacgccctgagcgggtctcaggaggctgaatttaccggatacggcaaagcgactttggagtgtcaggtccagacagcagtggatttcggtaattcctatatcgccgaaatggagaaggactcatggattgtagatcgccaatgggctcaggacctaaccctgccatggcagagcgggagtggcggaatctggagagaaatgcaccatctcgttgagtttgagccgccccacgccgcaacgatcagggtgctggcccttggcaaccaagaagggtctctgaagaccgctttgacaggagccatgcgggtcactaaagatgagaatgacaacaatctctacaagctgcatggtggccacgtgtcctgccgcgtcaaattaagcgcactgaccctaaaggggacatcgtataaaatgtgtactgataagatgtctttcgtgaagaaccctaccgacacaggacacggcaccgttgtgatgcaggtaaaagtcccaaagggtgcgccctgcaaaattcctgtgatagttgctgacgatctcactgccgcagtgaataaggggatcctggtcacggtgaacccaattgcctccacaaatgacgatgaagtacttatcgaggtgaatcccccgtttggcgactcatacataattgttggaaccggcgatagtagattgacttatcagtggcataaagaagggagctccatcggaaagctgttcacccagacaatgaagggtgctgagaggctcgccgtcatgggcgacgcagcttgggatttctctagcgccgggggatttttcacctcagtgggcaaaggtatccacactgtgtttgggagtgcgttccaaggcctgtttggaggcctttcctggattacaaaggtcatcatgggggccgttctgatttgggtgggaataaacacgcgtaacatgaccatgagcatgtctatgatcttggtgggcgtaattatgatgttcctctcactgggtgtcggggctgaccagggatgtgcagtgaattttggcaaa

SEQ ID NO: 761 - RNA, 2091 nt, synthetic construct
  misc_feature 1..2091: note = derived and/or modified CDS sequence (opt3) from YFV__KX010994__X-SS-prME-XX
  source 1..2091: mol_type = other RNA
atgagaggcctgagctccaggaagcggcgctctaacgagatggccatgttccccctccttctgttggggttactggctctatcaggaggtgtgaccctcgtccgtaaaaatcgatggctgcttctgaacgttacagcagaagacttgggcaagacttttagtgtggggacgggaaattgcaccacaaacatcctcgaggccaaatactggtgtcctgatagcatggaatataattgcccaaacctgtccccgagagaggaacccgacgatattgactgttggtgctacggcgtagagaatgtgagggtcgcgtatggtcggtgtgatgctgtggggcgctctaagagatcgaggcgggccatagacctgcctactcacgagaaccatggactcaaaacccgccaggaaaagtggatgacaggccgaatgggcgagagacaattacagaagatcgaaaggtggctggttcggaatccattctttgcagtgaccgcccttgctattgcatacttggtcgggaacaatactacacagcgtgtggtaatcgccctgctagttctcgctgtgggacccgcctattcagcgcactgcattggtatcaccgatcgcgacttcatagagggcgtccatgggggaacgtgggtgagcgcaactctggagcaggataaatgtgtgaccgtcatggcccctgacaagccaagtcttgatatctccctgcaaacagttgctattgacggccccgccgaagcaagaaaagtgtgctactctgctgtattgactcacgtgaagatcaacgataaatgtcctagcaccggtgaggcccatctcgcggaagagaatgacggggacaacgcctgcaagaggacatattccgatcggggatggggcaatggctgtgggctgtttggaaagggttcaattgtcgcatgcgctaaatttacctgcgccaagagtatgagcttattcgaagtggaccagacgaaaatccagtacgttatacgagctcagctgcacgtgggcgccaagcaagagaactggaacactgatattaaaacactcaagttcgacgcactttctgggtcccaggaggccgaatttaccggatacggcaaagctactctggagtgtcaggtccagacagcggtggatttcggtaattcatatatcgcagaaatggagaaggacagctggattgtagatcgccaatgggcccaggacttgaccctaccatggcagagtgggtctggcggaatctggagagaaatgcaccatctggttgagtttgagccgccccacgctgccacgatcagggtgctcgcactgggcaaccaagaagggtcccttaagaccgccctgacaggagctatgcgggtcactaaagatgagaatgacaacaatttgtacaagctccatggtggccacgtgagctgccgcgtcaaactgtcggccttaaccctgaaggggacatcttataaaatgtgtactgataagatgtccttcgtgaagaaccctaccgacacaggacacggcaccgttgtgatgcaggtaaaagtcccaaagggtgcaccctgcaaaattcctgtgatagttgcggacgatctaactgctgccgtgaataaggggatcctcgtcacggtgaacccaattgcatcaacaaatgacgatgaagtactgatcgaggtgaatcccccgtttggcgacagttacataattgttggaaccggcgatagcagacttacttatcagtggcataaagaagggtcctctatcggaaagttgttcacccagacaatgaagggtgccgagaggctggctgtcatgggcgacgccgcatgggatttcagctcagctgggggatttttcaccagtgtgggcaaaggtatccacactgtgtttgggtccgccttccaaggcctctttggaggcctgagctggattacaaaggtcatcatgggggcggttcttatttgggtgggaataaacacgcgtaacatgaccatgtctatgtcaatgatcctggtgggcgtaattatgatgttcttgagtctcggtgtcggggccgaccagggatgtgctgtgaattttggcaaa

SEQ ID NO: 762 - RNA, 2091 nt, synthetic construct
  misc_feature 1..2091: note = derived and/or modified CDS sequence (opt3) from YFV__KX027336__X-SS-prME-XX
  source 1..2091: mol_type = other RNA
atgagaggcctggccagcaggaagcggcgctccaacgagatggctatggtgcccctccttctgttggggttactggcactatctggaggtgtcaccctcgttcgtaaaaatcgatggctgcttctgaacgtgacagccgaagacttgggcaagactttctcagtagggacgggaaattgcaccacaaacatcctcgaggcgaaatactggtgtcctgatagtatggaatataattgcccaaacctgagcccgagagaggaacccgacgatattgactgttggtgctacggcgtggagaatgtcagggtggcttatggtcggtgtgatgccgttgggcgctccaagagatctaggcgggcaatagacctgcctactcacgagaaccatggactcaaaacccgccaggaaaagtggatgacaggccgaatgggcgagagacaattacagaagatcgaaaggtggctggtgcggaatccatttttcgccgtcaccgctcttgcaattgcctacttggtggggaacaatactacacagcgtgtagttatcgctctgctagtgctcgccgtcggacccgcgtattcggcacactgcattggtatcaccgatcgcgactttatagagggcgtgcatgggggaacgtgggtgtcagccactctggagcaggataaatgtgtcaccgttatggctcctgacaagccaagccttgatatcagtctgcaaacagtggccattgacggccccgcagaagctagaaaagtatgctactccgccgtgttgactcacgtcaagatcaacgataaatgtccttctaccggtgaggcgcatctcgccgaagagaatgacggggacaacgcatgcaagaggacatatagcgatcggggatggggcaatggctgtgggctgttcggaaagggttccattgtggcttgcgccaaatttacctgcgctaagtcaatgagtttattcgaagttgaccagacgaaaatccagtacgtgatacgagcccagctgcacgtcggcgcaaagcaagagaactggaacactgatattaaaacactcaagtttgacgcccttagcgggtctcaggaggctgagttcaccggatacggcaaagcgactctggaatgtcaggtgcagacagcagtagattttggtaattcctatatcgccgaaatggagaaggactcatggattgttgatcgccaatgggctcaggacttgaccctaccatggcagagcgggagtggcggaatctggagagaaatgcaccatctggtggagttcgagccgccccacgccgcaacgatcagggtcctcgccctgggcaaccaagaagggtctcttaagaccgctctgacaggagccatgcgggtgactaaagatgagaatgacaacaatttgtacaagctccatggtggccacgtctcctgccgcgtgaaactgagcgcattaaccctgaaggggacatcgtataaaatgtgtactgataagatgtcttttgttaagaaccctaccgacacaggacacggcaccgtggtaatgcaggtcaaagtgccaaagggtgcgccctgcaaaattcctgttatagtggctgacgatctaactgccgcagtcaataaggggatcctcgtgacggtaaacccaattgcctccacaaatgacgatgaagtgctgatcgaggttaatcccccgttcggcgactcatacataattgtcggaaccggcgatagtagacttacttatcagtggcataaagaagggagctccatcggaaagttgtttacccagacaatgaagggtgctgagaggctggccgtgatgggcgacgcagcttgggatttctctagcgccgggggattctttacctcagtgggcaaaggtatccacactgtcttcgggagtgcgtttcaaggcctcttcggaggcctgtcctggattacaaaggttatcatgggggccgtgcttatttgggtgggaataaacacgcgtaacatgaccatgagcatgtctatgatcctggtaggcgtcattatgatgtttttgtcactcggtgtgggggctgaccagggatgtgcagttaatttcggcaaa

SEQ ID NO: 763 - RNA, 2091 nt, synthetic construct
  misc_feature 1..2091: note = derived and/or modified CDS sequence (opt3) from YFV__JX898868__X-SS-prME-XX
  source 1..2091: mol_type = other RNA
atgagaggcctgagctccaggaagcggcgctctcacgacgccctcgctgtgcagttccttatcctggggatgttgttaatggcaggaggtgtcaccctggttcgtaaaaaccgatggctactcctgaatgtgacatcagaggatcttggcaagacttttagtgtagggacgggaaactgcaccacaaatattctggaagccaaatactggtgtcccgacagcatggagtataactgccctaatttgtccccaagagaggaaccggatgacatagattgttggtgctacggcgtggaaaacgtcagggtggcgtatggtaagtgtgactctgctgggcggtcgcgcagatcaaggcgggccatcgatctccccactcatgagaatcacggactgaaaacccgccaagagaagtggatgacaggccgaatgggcgaaagacagctgcagaagattgagaggtggctcgttcggaaccctttctttgcagtgaccgccttaactatcgcttacctggtcgggagcaatatgatgcagcgtgtggtaattgcacttttggttctggccgtgggaccagcttatagtgcccattgcatcggtataacagaccgcgatttcatcgaaggcgtccacgggggaacctgggtgtccgcgacgctagagcaagacaaatgtgtgactgtcatggcacccgataagccttctctcgacattagcctggagaccgttgccatcgatggcccagctgaagccagaaaagtgtgctacaacgcagtacttacacatgtgaagattaatgacaaatgtccctccactggtgaggctcacctggccgaagagaacgaaggggacaatgcgtgcaagaggacctattcagatcggggatggggcaacggctgtgggttgtttggaaagggtagtatcgtcgcctgcgcaaaattcacatgcgctaagagcatgtctctctttgaggtggaccagaccaaaatacagtacgttattcgagcccagctgcacgtgggcgctaagcaagagaattggaacacggatatcaaaactttaaagttcgacgccctgtccgggtcacaggaagcagagtttacaggatacggcaaagccaccctcgaatgtcaggtccagactgctgtggatttcggtaacagctatattgcggagatggaaaaggagagttggatcgtagaccgccaatgggcacaggatcttacactgccttggcagtctgggtccggcggagtttggagagagatgcatcacttggtggaatttgagccaccgcatgccgctaccatcagggtcctagccctgggcaatcaagaagggagcctcaagacggcactgaccggagccatgcgggtgacaaaagacactaacgataataacctttacaagctgcacggtggccacgtctcgtgccgcgtgaaattgtctgctctcaccctgaaggggacatcctataaaatgtgtactgacaagatgtcattcgttaagaatcccaccgatacaggacatggcaccgtggtaatgcaggtcaaagtgcctaagggtgccccatgcaaaattcccgttatagtggcagacgacttaactgcggctatcaacaaggggattctggtcacggtgaatcctatcgccagtacaaacgatgacgaggtactaatagaagtgaatccaccctttggcgatagctacattatcgttggaaccggcgactccagactcacttatcagtggcacaaagaggggtctagcatcggaaagctgttcacccagacaatgaagggtgcagagaggcttgccgtcatgggcgatgctgcctgggacttctcaagtgcagggggatttttcacctccgtgggcaaaggtattcatactgtgtttgggagcgctttccaaggcttgtttggaggcctgtcttggatcacaaaggtcattatgggggccgttctcatatgggtgggaatcaacacgcgtaatatgaccatgtcaatgagtatgattctggtgggcgtaatcatgatgttccttagcctgggtgtcggggcggatcagggatgtgccatcaactttggcaaa

SEQ ID NO: 764 - RNA, 2091 nt, synthetic construct
  misc_feature 1..2091: note = derived and/or modified CDS sequence (opt3) from YFV__JX898869__X-SS-prME-XX
  source 1..2091: mol_type = other RNA
atgagaggcctgagctccaggaagcggcgctctcacgacgtgctcaccgtccagttccttatcctggggatgttgttaatggccggaggtgttacactggtgcgtaaaaaccgatggctactcctgaatgtaacttcagaggatcttggcaagacgtttagtgtggggaccggaaactgcacaactaatattctggaagctaaatactggtgtcccgacagcatggagtataactgccctaatttgtccccaagagaggaaccggatgacatagattgttggtgctacggcgtcgaaaacgtgagggttgcatatggtaagtgtgactctgccgggcggtcgcgcagatcaaggcgggcgatcgatctccccacccatgagaatcacggactgaaaacacgccaagagaagtggatgaccggccgaatgggcgaaagacagctgcagaagattgagaggtggctcgtgcggaaccctttctttgctgtcactgccttaacaatcgcatacctggtggggagcaatatgacccagcgtgtagttattgcccttttggtgctggctgtcggaccagcatatagtgcccattgcatcggtataacggaccgcgatttcatcgaaggcgtgcacgggggaacttgggtgtccgctaccctagagcaagacaaatgtgtcacagttatggcccccgataagccttctctcgacattagcctggagactgtggcgatcgatggcccagcagaagccagaaaagtatgctacaacgctgtgcttacccatgtcaagattaatgacaaatgtccctccacaggtgaggcccacctggcagaagagaacgaaggggacaatgcttgcaagaggacctattcagatcggggatggggcaacggctgtgggttgtttggaaagggtagtatcgtggcctgcgcgaaattcacgtgcgccaagagcatgtctctctttgaggttgaccagactaaaatacagtacgtgattcgagcacagctgcacgtcggcgctaagcaagagaattggaacacagatatcaaaaccttaaagttcgacgccctgtccgggtcacaggaagctgagtttactggatacggcaaagccacactcgaatgtcaggtgcagaccgcagtagatttcggtaacagctatattgccgagatggaaaaggagagttggatcgttgaccgccaatgggctcaggatcttacgctgccttggcagtctgggtccggcggagtgtggagagagatgcatcacttggtcgaatttgagccaccgcatgcggcaaccatcagggtgctagccctgggcaatcaagaagggagcctcaagacagctctgactggagccatgcgggtcaccaaagacacaaacgataataacctttacaagctgcacggtggccacgtgtcgtgccgcgttaaattgtctgcactcactctgaaggggacctcctataaaatgtgtacagacaagatgtcattcgtgaagaatcccaccgatactggacatggcacggtagtcatgcaagtgaaagttcctaagggtgccccatgcaaaattcccgtgatagtcgctgacgacttaacagccgcagtgaacaaggggatcctggtaaccgtgaatcctattgcgagtactaacgatgacgaggttctaatcgaagtcaatccaccctttggcgatagctacataattgtgggaaccggcgactccagactcacatatcagtggcacaaagaggggtctagcatcggaaagctgttcacccagactatgaagggtgctgagaggcttgccgtgatgggcgatgcagcctgggacttctcaagtgctgggggatttttcacatccatcggcaaaggtattcatacggtctttgggagcgccttccagggcttgtttggaggcctgtcttggatcaccaaggttattatgggggcagtgctcatatgggtgggaatcaacactcgtaatatgacaatgtcaatgagtatgattctggtaggcgtcatcatgatgttccttagcctgggtgtgggggctgatcagggatgtgccatcaactttggcaaa

SEQ ID NO: 765 - RNA, 2091 nt, synthetic construct
  misc_feature 1..2091: note = derived and/or modified CDS sequence (opt3) from YFV__JX898873__X-SS-prME-XX
  source 1..2091: mol_type = other RNA
atgagaggcctgagctccaggaagcggcgctctcacgacgccctcaccgtgcagcttctgatcttggggatgattttaatggctggaggtgtcacactggttcgtaaaaaccgatggctactcctgaatgtgacttcagaggatcttggcaagacgttcagtgtagggaccggaaactgcacaactaatatactggaagcaaaatactggtgtcccgacagcatggagtataactgccctaatttgtccccaagagaggaaccggatgacatcgattgttggtgctacggcgtggaaaacgtcagggtggcctatggtaagtgtgactctgcggggcggtcgcgcagatcaaggcgggctattgatctccccacccatgagaatcacggactgaaaacacgccaagagaagtggatgaccggccgaatgggcgaaagacagctgcagaagatcgagaggtggctcgttcggaaccctttcttcgccgtgactgcattaacaattgcctacctggtcgggagcaatatgacccagcgtgtggtaatcgctcttttggttctggcagtgggaccagcctatagtgctcattgcataggtatcacggaccgcgattttattgaaggcgtccacgggggaacttgggtgtccgccaccctagagcaagacaaatgtgtgacagtcatggcgcccgataagccttctctcgacatcagcctggagactgttgcaattgatggcccagccgaagctagaaaagtgtgctacaacgccgtacttacccatgtgaagatcaatgacaaatgtccctccacaggtgaggcacacctggctgaagagaacgaaggggacaatgcctgcaagaggacctattcagatcggggatggggcaacggctgtgggttgttcggaaagggtagtatagtcgcgtgcgccaaatttacgtgcgcaaagagcatgtctctcttcgaggtggaccagactaaaattcagtacgttatccgagctcagctgcacgtgggcgccaagcaagagaattggaacacagatattaaaaccttaaagtttgacgctctgtccgggtcacaggaagccgagttcactggatacggcaaagcaacactcgaatgtcaggtccagaccgccgtggattttggtaacagctatatcgctgagatggaaaaggagagttggatcgtagaccgccaatgggcgcaggatcttacgctgccttggcagtctgggtccggcggagtttggagagagatgcatcacttggtggaatttgagccaccgcatgcagccaccattagggtcctagctctgggcaatcaagaagggagcctcaagacagccctgactggagcaacccgggtgacaaaagacactaacgataataacctttacaagctgcacggtggccacgtctcgtgccgcgtgaaattgtctgccctcaccctgaaggggacatcctataaaatgtgtaccgacaagatgtcatttgttaagaatcccactgatacgggacatggcacagtggtaatgcaggtcaaagtgcctaagggtgctccatgcaaaatacccgttatcgtggccgacgacttaaccgcagcgattaacaaggggatcctggtcactgtgaatcctatagctagtaccaacgatgacgaggtactaattgaagtgaatccacccttcggcgatagctacatcatcgttggaacaggcgactccagactcacctatcagtggcacaaagaggggtctagcattggaaagctgtttactcagacaatgaagggtgccgagaggcttgcagtcatgggcgatgccgcttgggacttctcaagtgccgggggattctttacgtccgtgggcaaaggtatccataccgtgttcgggagcgcatttcaaggcttgttcggaggcctgtcttggattactaaggtcataatgggggctgttctcatctgggtgggaattaacacacgtaatatgaccatgtcaatgagtatgatcctggtgggcgtaatcatgatgtttcttagcctgggtgtcggggccgatcagggatgtgcgattaacttcggcaaa

SEQ ID NO: 766 - RNA, 2091 nt, synthetic construct
  misc_feature 1..2091: note = derived and/or modified CDS sequence (opt3) from YFV__JX898874__X-SS-prME-XX
  source 1..2091: mol_type = other RNA
atgagaggcctgagctccaggaagcggcgctctcacgacgccctcaccgtgcagcttctgatcttggggatgattttaatggctggaggtgtcacactggttcgtaaaaaccgatggctactcctgaatgtgacttcagaggatcttggcaagacgttcagtgtagggaccggaaactgcacaactaatatactggaagcaaaatactggtgtcccgacagcatggagtataactgccctaatttgtccccaagagaggaaccggatgacatcgattgttggtgctacggcgtggaaaacgtcagggtggcctatggtaagtgtgactctgcggggcggtcgcgcagatcaaggcgggctattgatctccccacccatgagaatcacggactgaaaacacgccaagagaagtggatgaccggccgaatgggcgaaagacagctgcagaagatcgagaggtggctcgttcggaaccctttcttcgccgtgactgcattaacaattgcctacctggtcgggagcaatatgacccagcgtgtggtaatcgctcttttggttctggcagtgggaccagcctatagtgctcattgcataggtatcacggaccgcgattttattgaaggcgtccacgggggaacttgggtgtccgccaccctagagcaagacaaatgtgtgacagtcatggcgcccgataagccttctctcgacatcagcctggagactgttgcaattgatggcccagccgaagctagaaaagtgtgctacaacgccgtacttacccatgtgaagatcaatgacaaatgtccctccacaggtgaggcacacctggctgaagagaacgaaggggacaatgcctgcaagaggacctattcagatcggggatggggcaacggctgtgggttgttcggaaagggtagtatagtcgcgtgcgccaaatttacgtgcgcaaagagcatgtctctcttcgaggtggaccagactaaaattcagtacgttatccgagctcagctgcacgtgggcgccaagcaagagaattggaacacagatattaaaaccttaaagtttgacgctctgtccgggtcacaggaagccgagttcactggatacggcaaagcaacactcgaatgtcaggtccagaccgccgtggattttggtaacagctatatcgctgagatggaaaaggagagttggatcgtagaccgccaatgggcgcaggatcttacgctgccttggcagtctgggtccggcggagtttggagagagatgcatcacttggtggaatttgagccaccgcatgcagccaccattagggtcctagctctgggcaatcaagaagggagcctcaagacagccctgactggagcaatgcgggtgaccaaagacacaaacgataataacctttacaagctgcacggtggccacgtctcgtgccgcgtgaaattgtctgccctcactctgaaggggacctcctataaaatgtgtacagacaagatgtcatttgttaagaatcccaccgatactggacatggcacggtggtaatgcaggtcaaagtgcctaagggtgctccatgcaaaatacccgttatcgtggccgacgacttaacagcagcgattaacaaggggatcctggtcaccgtgaatcctatagctagtactaacgatgacgaggtactaattgaagtgaatccacccttcggcgatagctacatcatcgttggaaccggcgactccagactcacatatcagtggcacaaagaggggtctagcattggaaagctgtttacccagactatgaagggtgccgagaggcttgcagtcatgggcgatgccgcttgggacttctcaagtgccgggggattctttacatccgtgggcaaaggtatccatacggtgttcgggagcgcatttcaaggcttgttcggaggcctgtcttggattaccaaggtcataatgggggctgttctcatctgggtgggaattaacactcgtaatatgacaatgtcaatgagtatgatcctggtgggcgtaatcatgatgtttcttagcctgggtgtcggggccgatcagggatgtgcgattaacttcggcaaa

SEQ ID NO: 767 - RNA, 2091 nt, synthetic construct
  misc_feature 1..2091: note = derived and/or modified CDS sequence (opt3) from YFV__JX898875__X-SS-prME-XX
  source 1..2091: mol_type = other RNA
atgagaggcctgagctccaggaagcggcgctctcacgacgccctcaccgtgcagcttctgatcttggggatgattttaatggctggaggtgtcacactggttcgtaaaaaccgatggctactcctgaatgtgacttcagaggatcttggcaagacgttcagtgtagggaccggaaactgcacaactaatatactggaagcaaaatactggtgtcccgacagcatggagtataactgccctaatttgtccccaagagaggaaccggatgacatcgattgttggtgctacggcgtggaaaacgtcagggtggcctatggtaagtgtgactctgcggggcggtcgcgcagatcaaggcgggctattgatctccccacccatgagaatcacggactgaaaacacgccaagagaagtggatgaccggccgaatgggcgaaagacagctgcagaagatcgagaggtggctcgttcggaacccatttttcgccgtgactgcattaacaattgcctacctggtcgggagcaatatgacccagcgtgtggtaatcgctcttttggttctggcagtgggacctgcctatagtgctcattgcataggtatcacggaccgcgattttattgaaggcgtccacgggggaacttgggtgtccgccaccctagagcaagacaaatgtgtgacagtcatggcgcccgataagccttctctcgacatcagcctggagactgttgcaattgatggcccagccgaagctagaaaagtgtgctacaacgccgtacttacccatgtgaagatcaatgacaaatgtccctccacaggtgaggcacacctggctgaagagaacgaaggggacaatgcctgcaagaggacctattcagatcggggatggggcaacggctgtgggttgttcggaaagggtagtatagtcgcgtgcgccaaatttacgtgcgcaaagagcatgtctctcttcgaggtggaccagactaaaattcagtacgttatccgagctcagctgcacgtgggcgccaagcaagagaattggaacacagatattaaaaccttaaagtttgacgctctgtccgggtcacaggaagccaaattcactggatacggcaaggcaacactcgagtgtcaggtccagaccgccgtggattttggtaacagctatatcgctgaaatggagaaggaaagttggatcgtagaccgccaatgggcgcaggatcttacgctgccttggcagtctgggtccggcggagtttggagagagatgcatcacttggtggagttcgaaccaccgcatgcagccaccattagggtcctagctctgggcaatcaagaggggagcctcaaaacagccctgactggagcaatgcgggtgaccaaggacacaaacgataataacctttacaaactgcacggtggccacgtctcgtgccgcgtgaagttgtctgccctcactctgaaagggacctcctataagatgtgtacagacaagatgtcatttgttaaaaatcccaccgatactggacatggcacggtggtaatgcaggtcaaggtgcctaaaggtgctccatgcaagatacccgttatcgtggccgacgacttaacagcagcgattaacaaagggatcctggtcaccgtgaatcctatagctagtactaacgatgacgaagtactaattgaggtgaatccacccttcggcgatagctacatcatcgttggaaccggcgactccagactcacatatcagtggcacaaggaagggtctagcattggaaagctgtttacccagactatgaaaggtgccgagaggcttgcagtcatgggcgatgccgcttgggacttctcaagtgccgggggattctttacatccgtgggcaagggtatccatacggtgttcgggagcgcatttcaaggcttgttcggaggcctgtcttggattaccaaagtcataatgggggctgttctcatctgggtgggaattaacactcgtaatatgacaatgtcaatgagtatgatcctggtgggcgtaatcatgatgtttcttagcctgggtgtcggggccgatcagggatgtgcgattaacttcggcaag

SEQ ID NO: 768 - RNA, 2091 nt, synthetic construct
  misc_feature 1..2091: note = derived and/or modified CDS sequence (opt3) from YFV__JX949181__X-SS-prME-XX
  source 1..2091: mol_type = other RNA
atgagaggcctgagctccaggaagcggcgctctcacgacgtgctcaccgtccagttccttatcctggggatgttgttaatgacaggaggtgttactctggtgcgtaaaaaccgatggctactcctgaatgtaacgtcagaggatcttggcaagacctttagtgtggggacaggaaactgcactaccaatattctggaagccaaatactggtgtcccgacagcatggagtataactgccctaatttgtccccaagagaggaaccggatgacatagattgttggtgctacggcgtcgaaaacgtgagggttgcttatggtaagtgtgactctgcagggcggtcgcgcagatcaaggcgggccatcgatctccccacacatgagaatcacggactgaaaacccgccaagagaagtggatgactggccgaatgggcgaaagacagctgcagaagattgagaggtggttcgtgcggaaccctttcttcgcggtcacagctctcaccatcgcctacttagtggggagcaatatgacgcagcgtgtagttattgcactgcttgtgttggccgtcggaccagcttatagtgcacattgcatcggtataactgaccgcgattttatcgaaggcgtgcacgggggaacctgggtgtccgccacactggagcaagacaaatgtgtcactgttatggctcccgataagccttctctagacattagcctcgagaccgtggccatcgatagaccagcggaagtaaggaaagtgtgctacaacgcagtcctgacacatgtgaagattaatgacaaatgtccctccaccggcgaggcccaccttgctgaagagaacgaaggtgacaatgcctgcaagcggacgtattcagatcgagggtggggaaacggctgtggcctgttcgggaagggaagtatcgttgcatgcgctaaatttacttgcgccaagagcatgtctttgttcgaggtggaccagacaaaaatacagtacgtcattcgcgcgcagctccacgtgggtgccaagcaagagaattggaccactgatatcaaaacactgaagtttgacgcattatccggctcacaggaagtagagttcattgggtacggaaaagctaccctggaatgtcaggttcagacggccgtggattttggcaacagctatatcgctgagatggaaaccgagagttggatcgtcgacagacaatgggcccaggatctcacacttccttggcagtctggttccgggggcgtgtggagggagatgcatcacctggtcgaatttgagccaccgcatgcagccactattcgggtgttggctctaggaaaccaagaaggcagcctgaagaccgcgctcacaggggcaatgcgcgttactaaggacaccaatgataacaatctgtacaaacttcacggaggtcacgtgtcgtgcagagtaaagctgtctgccttgacactcaaaggcacctcctataagatatgtactgacaaaatgtttttcgtcaagaaccccacggatacagggcatggaaccgtggttatgcaagtgaaggtctcaaaaggcgctccttgcaggatcccagtgattgtagccgacgacctgactgcagccatcaataagggtatattagtgaccgttaaccccattgctagtacaaatgatgacgaggtcctgatcgaagtgaaccctccattcggggatagctacatcattgtgggccgtggagactcccggctaacctatcagtggcacaaagagggctctagcatcgggaagctctttactcagacaatgaaaggagtcgagcgactggccgttatgggtgatacggcatgggacttctcaagtgcgggcgggtttttcacctccgtgggaaagggcattcatactgtgtttggtagcgctttccaggggctttttggcggattgaattggataacaaaggtaatcatgggcgtcgtgctgatttgggttgggatcaacaccagaaatatgacaatgtctatgtcaatgatcctcgtgggagtcattatgatgttcctgagtcttggcgtgggtgccgatcaggggtgtgcaataaactttggaaaa

SEQ ID NO: 769 - RNA, 2091 nt, synthetic construct
  misc_feature 1..2091: note = derived and/or modified CDS sequence (opt3) from YFV__AY968064__X-SS-prME-XX
  source 1..2091: mol_type = other RNA
atgagaggcctgagctccaggaagcggcgctctaacgagatggccctcttcccccttctgttgttagggctgctagctctctcaggaggtgtgaccctggtccgtaaaaatcgatggcttctgttgaacgttacagcagaagacctcggcaagacttttagtgtggggacgggaaattgcaccacaaacatcctggaggccaaatactggtgtcctgatagcatggaatataattgcccaaacctgtccccgagagaggaacccgacgatattgactgttggtgctacggcgtagagaatgtgagggtcgcgtatggtcggtgtgatgctgtggggcgctctaagagatcgaggcgggccatagacctccctactcacgagaaccatggattaaaaacccgccaggaaaagtggatgacaggccgaatgggcgagagacaactgcagaagatcgaaaggtggcttgttcggaatccattctttgcagtgaccgccttggctattgcatacctggtcgggaacaatactacacagcgtgtggtaatcgccctactcgttctggctgtgggacccgcctattcagcgcactgcattggtatcaccgatcgcgacttcatagagggcgtccatgggggaacgtgggtgagcgcaactcttgagcaggataaatgtgtgaccgtcatggcccctgacaagccaagtctggatatctccttgcaaacagttgctattgacggccccgccgaagcaagaaaagtgtgctactctgctgtactcactcacgtgaagatcaacgataaatgtcctagcaccggtgaggcccatctggcggaagagaatgacggggacaacgcctgcaagaggacatattccgatcggggatggggcaatggctgtgggttatttggaaagggttcaattgtcgcatgcgctaaatttacctgcgccaagagtatgagcctgttcgaagtggaccagacgaaaatccagtacgttatacgagctcagctccacgtgggcgccaagcaagagaactggaacactgatattaaaacacttaagttcgacgcactgtctgggtcccaggaggccgaatttaccggatacggcaaagctactttggagtgtcaggtccagacagcggtggatttcggtaattcatatatcgcagaaatggagaaggacagctggattgtagatcgccaatgggcccaggacctaaccctgccatggcagagtgggtctggcggaatctggagagaaatgcaccatctcgttgagtttgagccgccccacgctgccacgatcagggtgctggcacttggcaaccaagaagggtccctgaagaccgccttgacaggagctatgcgggtcactaaagatgagaatgacaacaatctctacaagctgcatggtggccacgtgagctgccgcgtcaaattatcggccctgaccctaaaggggacatcttataaaatgtgtactgataagatgtccttcgtgaagaaccctaccgacacaggacacggcaccgttgtgatgcaggtaaaagtcccaaagggtgcaccctgcaaaattcctgtgatagttgcggacgatctcactgctgccgtgaataaggggatcctggtcacggtgaacccaattgcatcaacaaatgacgatgaagtacttatcgaggtgaatcccccgtttggcgacagttacataattgttggaaccggcgatagcagattgacttatcagtggcataaagaagggtcctctatcggaaagctgttcacccagacaatgaagggtgccgagaggctcgctgtcatgggcgacgccgcatgggatttcagctcagctgggggatttttcaccagtgtgggcaaaggtatccacactgtgtttgggtccgccttccaaggcctgtttggaggccttagctggattacaaaggtcatcatgggggcggttctgatttgggtgggaataaacacgcgtaacatgaccatgtctatgtcaatgatcttggtgggcgtaattatgatgttcctcagtctgggtgtcggggccgaccagggatgtgctgtgaattttggcaaa

SEQ ID NO: 770 - RNA, 2091 nt, synthetic construct
  misc_feature 1..2091: note = derived and/or modified CDS sequence (opt3) from YFV__AY968065__X-SS-prME-XX
  source 1..2091: mol_type = other RNA
atgagaggcctgagctccaggaagcggcgatcttcagagatgaccatgatgcccctccttatcctgagtatggtgattttagggggaggtgtcacattggttcgcaaaaaccgttggctgctactcaatgtgactgccgaagacctgggcaagacgttcagcgtagggaccggaaactgcacaactaatatacttgaggctaaatactggtgtcctgattccatggaatataactgcccaaatctgtctccgagagaggaacccgacgatatcgactgttggtgctacggcgtggagaacgtcagggtggcatatggtcggtgtgatgccgttgggcgctcgaagagatcaaggcgggcgattgacttgcctacccacgagaatcatggactcaaaacacgccaggaaaagtggatgaccggccgaatgggcgagagacaactgcagaagatcgaaaggtggctggtgcggaacccatttttcgctgtcactgccctcgcaattgcctacttagtggggaataacaaaacacagcgtgtagttatcgctctgcttgtgttggcagtcggacccgcctatagcgctcactgcataggtatcaccgatcgcgactttattgagggcgtgcatgggggaacgtgggtgagtgcctccctggagcaggataagtgtgtcactgttatggcgcctgacaaaccatctctagatatcagcctccaaaccgtggcaattgacggccccgccgaagctagaaaggtatgctactccgccgtgctgacacacgtcaaaatcaatgataagtgtccttcaactggtgaggcacatcttgctgaagagaacgacggggacaatgcctgcaagaggacctatagtgatcggggatggggcaacggctgtgggctgttcggaaaaggtagcatagtggcgtgcgccaagtttacatgcgcaaaatctatgtccttgttcgaagttgaccagaccaagattcagtacgtgatccgagctcagctccacgtcggcgccaaacaagagaattggaacacggatattaagactctgaaatttgacgctttatcagggagccaggaggccgagttcacaggatacggcaaggcaaccctggaatgtcaggtgcagactgccgtagattttggtaacagttatatcgctgaaatggagaaggactcttggatcgttgatcgccaatgggcgcaggacctcacacttccatggcagtccgggagcggcggaatttggagagaaatgcaccatctggtggagttcgagccgccccacgcagccaccataagggtcttggctctaggcaatcaagaagggtcgctgaaaacggccctcaccggagcaatgcgggtgacaaaggatgagaacgacaataacctgtacaaacttcatggtggccacgtctcttgccgcgtgaagctgtccgccttgactctcaaagggacctcatataagatgtgtacagataagatgagttttgttaaaaatcctactgacaccggacacggcacagtggtaatgcaggtcaaggtgccaaaaggtgctccctgcaagatccctgttattgtggccgacgatctgaccgcagcggtcaacaaagggatcttagtgactgtaaatccaatagctagcacgaacgacgatgaagtgctgattgaggttaatcccccgttcggcgactcctacatcatcgtcggaacaggcgattctagactaacctatcagtggcataaggaagggagctcaattggaaagctctttactcagaccatgaaaggtgtggagaggctggccgtgatgggcgacgcagcctgggatttcagttccgctgggggattctttacaagcgtcggcaagggtatccacaccgttttcgggtctgcctttcaaggccttttcggaggcttgtcatggattactaaagtgataatgggggcagtgctgatctgggtaggaattaacacacgtaatatgacgatgagtatgagcatgatcctcgtcggcgtgatcatgatgtttctgtcccttggtgttggggctgaccagggatgtgccgtgaacttcggcaag

SEQ ID NO: 771 - RNA, 2061 nt, synthetic construct
  misc_feature 1..2061: note = derived and/or modified CDS sequence (opt4) from YFV__L06480__X-SS-prME-XX
  source 1..2061: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccagcatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgcccaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacgtggcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 772 - RNA, 2091 nt, synthetic construct
  misc_feature 1..2091: note = derived and/or modified CDS sequence (opt4) from YFV__D14458__X-SS-prME-XX
  source 1..2091: mol_type = other RNA
atgagaggcctgagcagcagaaagagaagaagctacgaggtgctgaccgtgcagttcctgatcctgggcatgctgctgatgaccggcggcgtgaccctggtgagaaagagcagatggctgctgctgaacgtgaccagcgaggacctgggcaagaccttcagcgtgggcaccggcaactgcaccaccaacatcctggaggccaagaactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgacccacgtgaagatcaacgacaagtgccccagcaccggcgaggcccacctggccgaggagaacgagggcgaccacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacgccgacatcaagaccctgaagttcgacgccctgagcggcagccaggaggccgagttcaccggctacggcaaggccaccctggagtgccaggtgcagaccgccgtggacttcagcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacggcagcaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccagcgtgaacaagggcatcctggtgaccgtgaaccccatcgccagcaccaacgaggacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacatggtgttcggcagcgccttccagggcctgttcggcggcctgagctggatcaccaaggtgatcatgggcgccgtgctgatctgggtgggcatcaacatgagaaacatgaccatgagcatgagcatgatcctggtgggcgtgatcatgatgttcctgagcctgggcgtgggcgccgaccagggctgcgccatcaacttcggcaag

SEQ ID NO: 773 - RNA, 2091 nt, synthetic construct
  misc_feature 1..2091: note = derived and/or modified CDS sequence (opt4) from YFV__U21055__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcatgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgtggaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagccagactgcacgtgggcgccaagcaggagaactggaagaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcgaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgaactggatcaccaaggtgatcatcggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcgccaag

SEQ ID NO: 774 - RNA, 2091 nt, synthetic construct
  misc_feature 1..2091: note = derived and/or modified CDS sequence (opt4) from YFV__U21056__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagaggcatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgtggagagactggccgtgatgggcgacgccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 775 - RNA, 2091 nt, synthetic construct
  misc_feature 1..2091: note = derived and/or modified CDS sequence (opt4) from YFV__U54798__X-SS-prME-XX
  source 1..2091: mol_type = other RNA
atgagaggcctgagcagcagaaagagaagaagccacgacgtgctgaccgtgcagttcctgatcctgggcatgctgctgatggccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgcagagtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccgaccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcctgttcaccagcatcggcaagggcagccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 776 - RNA, 2061 nt, synthetic construct
  misc_feature 1..2061: note = derived and/or modified CDS sequence (opt4) from YFV__AF052440__X-SS-prME-XX
  source 1..2061: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaccaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 777 - RNA, 2091 nt, synthetic construct
  misc_feature 1..2091: note = derived and/or modified CDS sequence (opt4) from YFV__AF052445__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgtggtgctgatctgggtgggcatcaacaccagaaacatgaccatgagcatgagcatgatcatggtgggcgtgatcatgatgttcctgagcctgggcgtgggcgccgaccagggctgcgccatcaacttcggcaag

SEQ ID NO: 778 - RNA, 2091 nt, synthetic construct
  misc_feature 1..2091: note = derived and/or modified CDS sequence (opt4) from YFV__AF094612__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctgatgagaaagaacagatggctgctgctgaacgtgaccagcgaggacctgggcaagaccttcagcatcggcaccggcaactgcaccaccaacatcctggaggccaagtactggtgccccgacagcatggagtacaactgccccaacctgagccccagagaggagcccgacgacatcgactgctggtgctacggcgtggagaacgtgagagtgacctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcgtggccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgtggaggccagaaaggtgtgctacaacgccgtgctgacccacgtgaagatcgacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcaaggcccagctgcacgtgggcgccaagcaggaggactggaagaccgacatcaagaccctgaagttcgacgtgctgagcggcagccaggaggccgagttcaccggctacggcaaggtgaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcgaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcatcggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcttcaacaccagaaacatgaccatgagcatgagcatgatcctggtgggcgtgatcatgatgttcctgagcctgggcgtgggcgccgaccagggctgcgccatcaacttcggcaag

SEQ ID NO: 779 - RNA, 2091 nt, synthetic construct
  misc_feature 1..2091: note = derived and/or modified CDS sequence (opt4) from YFV__KF769015__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaccaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 780 - RNA, 2091 nt, synthetic construct
  misc_feature 1..2091: note = derived and/or modified CDS sequence (opt4) from YFV__KF769016__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 781 - RNA, 2091 nt, synthetic construct
  misc_feature 1..2091: note = derived and/or modified CDS sequence (opt4) from YFV__KF907504__X-SS-prME-XX
  source 1..2091: mol_type = other RNA
atgagaggcctgagcagcagaaagagaagaagccacgaggtgctgaccgtgcagttcctgatcctgggcatgctgctgatgaccggcggcgtgaccctggtgagaaagagcagatggctgctgctgaacgtgaccagcgaggacctgggcaagaccttcagcgtgggcaccggcaactgcaccaccaacatcctggaggccaagaactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgacccacgtgaagatcaacgacaagtgccccagcaccggcgaggcccacctggccgaggagaacgagggcgaccacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacgccgacatcaagaccctgaagttcgacgccctgagcggcagccaggaggccgagttcaccggctacggcaaggccaccctggagtgccaggtgcagaccgccgtggacttcagcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacggcagcaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccagcgtgaacaagggcatcctggtgaccgtgaaccccatcgccagcaccaacgaggacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacatggtgttcggcagcgccttccagggcctgttcggcggcctgagctggatcaccaaggtgatcatgggcgccgtgctgatctgggtgggcatcaacatgagaaacatgaccatgagcatgagcatgatcctggtgggcgtgatcatgatgttcctgagcctgggcgtgggcgccgaccagggctgcgccatcaacttcggcaga

SEQ ID NO: 782 - RNA, 2091 nt, synthetic construct
  misc_feature 1..2091: note = derived and/or modified CDS sequence (opt4) from YFV__JF912179__X-SS-prME-XX
  source 1..2091: mol_type = other RNA
atgagaggcctgagcagcagaaagagaagaagccaggacgccctgaccgtgcagttcctgatcctgggcatgctgctgatggtgggcggcgtgaccctggtgagaagaaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcagcaag

SEQ ID NO: 783 - RNA, 2091 nt, synthetic construct
  misc_feature 1..2091: note = derived and/or modified CDS sequence (opt4) from YFV__JF912180__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaagaaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 784 - RNA, 2091 nt, synthetic construct
  misc_feature 1..2091: note = derived and/or modified CDS sequence (opt4) from YFV__JF912181__X-SS-prME-XX
  source 1..2091: mol_type = other RNA
atgagaggcctgagcagcagaaagagaagaagccacgaggtgctgaccgtgcacttcctgatcctgggcatgatgctgatgaccggcggcgtgaccctggtgagaaagagcagatggctgctgctgaacgtgaccagcgaggacctgggcaagaccttcagcgtgggcaccggcaactgcaccaccaacatcctggacgccaagaactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacgccgacatcaagaccctgaagttcgacgccctgagcggcagccaggaggccgagttcaccggctacggcaaggccaccctggagtgccaggtgcagaccgccgtggacttcagcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacgccaacggcagcaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgaggacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacatggtgttcggcagcgccttccagggcctgttcggcggcctgagctggatcaccaaggtgatcatcggcgccgtgctgatctgggtgggcatcaacatgagaaacatgaccatgagcatgggcatgatcctggtgggcgtgatcatgatgttcctgagcctgggcgtgggcgccgaccagggctgcgccatcaacttcggcaag

SEQ ID NO: 785 - RNA, 2091 nt, synthetic construct
  misc_feature 1..2091: note = derived and/or modified CDS sequence (opt4) from YFV__JF912182__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcgcctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcagagccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 786 - RNA, 2091 nt, synthetic construct
  misc_feature 1..2091: note = derived and/or modified CDS sequence (opt4) from YFV__JF912183__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaagaaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 787 - RNA, 2091 nt, synthetic construct
  misc_feature 1..2091: note = derived and/or modified CDS sequence (opt4) from YFV__JF912184__X-SS-prME-XX
  source 1..2091: mol_type = other RNA
atgagaggcctgagcagcagaaagagaagaagccaggacgccctgaccgtgcagttcctgatcctgggcatgctgctgatggtgggcggcgtgaccctggtgagaagaaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcagcaacagctacatcgccgagagagagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 788 - RNA, 2091 nt, synthetic construct
  misc_feature 1..2091: note = derived and/or modified CDS sequence (opt4) from YFV__JF912185__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcagagccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 789 - RNA, 2091 nt, synthetic construct
  misc_feature 1..2091: note = derived and/or modified CDS sequence (opt4) from YFV__JF912186__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaagaagcagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 790 - RNA, 2091 nt, synthetic construct
  misc_feature 1..2091: note = derived and/or modified CDS sequence (opt4) from YFV__JF912187__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaagaaacagatggctgctgctgaacgtgaccagcgaggacctgggcaagaccttcagcgtgggcaccggcaactgcaccaccaacatcctggaggccaagtactggtgcagcgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcagagccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 791 - RNA, 2091 nt, synthetic construct
  misc_feature 1..2091: note = derived and/or modified CDS sequence (opt4) from YFV__JF912189__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaagaaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgtgaagcaggagaactggaacaccgacatcaagaccctgaagttcgacgccctgagcggcagccaggaggccgagttcaccggctacggcagagccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 792 - RNA, 2061 nt, synthetic construct
  misc_feature 1..2061: note = derived and/or modified CDS sequence (opt4) from YFV__AH005112__X-SS-prME-XX
  source 1..2061: mol_type = other RNA
atgagaggcctgagcagcagaaagagaagaagccacgacgtgctgaccgtgcagttcctgatcctgggcatgctgctgatggccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagaccatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgagaggccaggagagactggccgtgatgggcgacaccgcctgggacttcagcagcgccggcggcttcttcaccagcatcggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 793 - RNA, 2091 nt, synthetic construct
  misc_feature 1..2091: note = derived and/or modified CDS sequence (opt4) from YFV__FJ654700__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcaccggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgtgaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 794 - RNA, 2091 nt, synthetic construct
  misc_feature 1..2091: note = derived and/or modified CDS sequence (opt4) from YFV__KM388817__X-SS-prME-XX
  source 1..2091: mol_type = other RNA
atgagaggcctgagcagcagaaagagaagaagccaggacgtgctgaccgtgcagttcctgatcctgggcatgctgctgatggccggcggcgtgaccctggtgagaagaaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcagagccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 795 - RNA, 2091 nt, synthetic construct
  misc_feature 1..2091: note = derived and/or modified CDS sequence (opt4) from YFV__HM582851__X-SS-prME-XX
  source 1..2091: mol_type = other RNA
atgagaggcctgagcagcagaaagagaagaagccaggacgtgctgaccgtgcagttcctgatcctgggcatgctgctgatggtgggcggcgtgaccctggtgagaagaaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgccaccgccctggccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacagcgccgtgctgaccaacgtgaagatcaacgacaagtgccccagcaccggcgaggcccacctggaggaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcagagccaccctggagtgccaggtgcagaccgccgtggacttcagcaacagctacatcgccgagatggagaaggagagctggatcgtggacaagcagtgggcccaggacctgaccctgccctggcagagcggcagcggcggcgtgtggagagagatgcaccacctggtggagttcgagcccccccacgccgccaccatcaaggtgctggccctgggcaaccaggagggcagcctgaagaccgccctgaccggcgccatgagagtgaccaaggacaccaacaacagcaagctgtacaagctgcacggcggccacgtggcctgcagagtgaagctgagcgccctgaccctgaagggcaccagctacaagatgtgcaccgacaagatgagcttcgtgaagaaccccaccgacaccggccacggcaccgccgtgatgcaggtgaaggtgcccaagggcgccccctgcagaatccccgtgatggtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcggcagcgccggcggcttcttcaccagcgtgggcaagggcatccacaccgtgttcggcagcgccttccagggcctgttcggcggcctgagctggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 796 - RNA, 2091 nt, synthetic construct
  misc_feature 1..2091: note = derived and/or modified CDS sequence (opt4) from YFV__JN620362__X-SS-prME-XX
  source 1..2091: mol_type = other RNA
atgagaggcctgagcagcagaaagagaagaagcaacgagatgaccatgatgcccctgctgatcctgagcatggtgatcctggccggcggcgtgaccctggtgagaaagaacagatggctgctgctgaacgtgaccgccgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcagatgcgacgccgtgggcagaagcaagagaagcagaagagccatcgacctgcccacccacgagaaccacggcctgaagaccagacaggagaagtggatgaccggcagaatgggcgagagacagctgcagaagatcgagagatggctggtgagaaaccccttcttcgccatcaccgccctggccatcgcctacctggtgggcaacaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctgcagaccgtggccatcgacggccccgccgaggccagaaaggtgtgctacagcgccgtgctgacccacgtgaagatcaacgacaagtgccccagcaccggcgaggcccacctggccgaggagaacgacggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggacagctggatcgtggacagacagtgggcccaggacctgaccctgccctggcagagcggcagcggcggcatctggagagagatgcaccacctggtggagttcgagcccccccacgccgccaccatcagagtgctggccctgggcaaccaggagggcagcctgaagaccgccctgaccggcgccatgagagtgaccaaggacgagaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccgtgaacttcggcaag

SEQ ID NO: 797 - RNA, 2091 nt, synthetic construct
  misc_feature 1..2091: note = derived and/or modified CDS sequence (opt4) from YFV__JN811142__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaccaccgacatcaagaccctgagattcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 798 - RNA, 2091 nt, synthetic construct
  misc_feature 1..2091: note = derived and/or modified CDS sequence (opt4) from YFV__DQ100292__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgcccaagggcgccccctgcagaatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 799 - RNA, 2091 nt, synthetic construct; identical to SEQ ID NO: 248
  misc_feature 1..2091: note = derived and/or modified CDS sequence (opt4) from YFV__DQ118157__X-SS-prME-XX
  source 1..2091: mol_type = other RNA

SEQ ID NO: 800 - RNA, 2091 nt, synthetic construct
  misc_feature 1..2091: note = derived and/or modified CDS sequence (opt4) from YFV__DQ235229__X-SS-prME-XX
  source 1..2091: mol_type = other RNA
atgatcggcctgagcagcagaaagagaagaagcaacgagatggccatgatgcccctgctgatcctgagcatggtgatcctggccggcggcgtgaccctggtgagaaagaacagatggctgctgctgaacgtgaccgccgaggacctgggcaagaccttcagcctgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcagatgcgacgccgtgggcagaagcaagagaagcagaagagccatcgacctgcccacccacgagaaccacggcctgaagaccagacaggagaagtggatggccggcagaatgggcgagagacagctgcagaagatcgagagatggctggtgagaaaccccttcttcgccatcaccgccctggccatcgcctacctggtgggcaacaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcagggcaagtgcgtgaccgtgatggcccccgacaagcccagcctggacatcagcctgcagaccgtggccatcgacggccccgccgaggccagaaaggtgtgctacagcgccgtgctgacccacgtgaagatcaacgacaagtgccccagcaccggcgaggcccacctggccgaggagaacgacggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggacagctggatcgtggacagacagtgggcccaggacctgaccctgccctggcagagcggcagcggcggcatctggagagagatgcaccacctggtggagttcgagcccccccacgccgccaccatcagagtgctggccctgggcaaccaggagggcagcctgaagaccgccctgaccggcgccatgagagtgaccaaggacgagaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccgtgaacttcggcaag

SEQ ID NO: 801 - RNA, 2088 nt, synthetic construct
  misc_feature 1..2088: note = derived and/or modified CDS sequence (opt4) from YFV__DQ322633__X-SS-prME-XX
  source 1..2088: mol_type = other RNA
atgggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 802 - RNA, 2067 nt, synthetic construct
  misc_feature 1..2067: note = derived and/or modified CDS sequence (opt4) from YFV__DQ322634__X-SS-prME-XX
  source 1..2067: mol_type = other RNA
atgagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 803 - RNA, 2061 nt, synthetic construct
  misc_feature 1..2061: note = derived and/or modified CDS sequence (opt4) from YFV__DQ322642__X-SS-prME-XX
  source 1..2061: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgcc

SEQ ID NO: 804 - RNA, 2091 nt, synthetic construct
  misc_feature 1..2091: note = derived and/or modified CDS sequence (opt4) from YFV__GQ379162__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccagcatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgcccaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacgtggcctgggacttcagcagcgccggcggcttcttcaccagcgtgggcaagggcatccacaccgtgttcggcagcgccttccagggcctgttcggcggcctgaactggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 805 - RNA, 2085 nt, synthetic construct
  misc_feature 1..2085: note = derived and/or modified CDS sequence (opt4) from YFV__DQ859065__X-SS-prME-XX
  source 1..2085: mol_type = other RNA
atgctgaagggcgtgagcggcagaaagaagagaagaagcgtggaggccaccggcttcgtgagcaccctgctgttcggcatcgtgctgaccgccagcgtgagcagacacgcccaccacaccctgctgaacgtgaccaaggaggacaccaaccagatcctgaccctgagaaacggcaactgcaccgtggtgagcatggacgtgggcagctggtgcgacgacaacgtggagtacgactgcgtgaccctgcaggacaacgaggagcccgacgacgtggactgctggtgctacaaggtgaacggcgtgagagtgacctacggcaagtgcagagagggcaacacccccagaagaagcaagagagccgtggtgatcaccgcccacctggaccagggcctgaccaccaagaaggagacctggctgggcagcagccacttcgagacccagatccagaagatcgagaagtggatcatcagaaaccccacctacgccatcgccgccatcatcatggcctggtacatcggcaacagcaccaagcagagagtggtgctgctgctgctgaccctggccctgggccccgcctacgccacccactgcgtgggcatcgccaagagagacttcgtgcagggcgtgcagggcaccacctgggtgaacgtggtgatggagcagggcgcctgcgtgaccatcgtgaccgagggcaagcccagcgtggacgtgtggatggagggcatcaccttcagcagccccaccatggtgagaagaatcagccacaccgccaccatcagcgacaccaagatcagcagcgcctgccccagcaccggcgaggccaagctggacgaggagcacgacaagaccttcgagtgcaagagaacctacagcgacagaggctggggcaacggctgcggcctgttcggcaagggcagcatcgtggcctgcgccaagttcaccagcaccggccacatggacgtgtacgagatggacatgaccaaggtggagtacaccatcaagacccaggtgcacagcggcgccaagagcgacgacaccaccggcgtgaaggagatcaagttcacccccgtgagcggcacccagaccgtggagttccccggctacggcaacctgggcctggagtgcatcgtgcagagcgacatcgacttcaccacccactacctggtggtgctgggcaccgacgcctggctggtgcacaaggcctgggtggaggacgtgaccctgccctggaagcacgagggcgccgccagctggagagacaagcagtacctggtggagttcggcgagccccacgccgccaccatcaaggtgctggtgctgggcagccaggagggcgccctgagaaccgccctggccggcgccatgatggtgacccacgacagcagcgccaagaccttcaagctgcacggcggccacgtgacctgcaaggccaagctgaacgacctggtgatcaagggcaccacctacaccaactgcagaggcggcctgagcttcgtgaagacccccaccgacaccggccacggcaccgtggtgatgcaggtgaaggtgagcagaaacgccccctgcagactgaccgtgatcgccgccgacgacgccagcggccacgtgaacagaggcaccctggtgaccagcaaccccatcgccaacagcaacaacgacgaggtgctggtggaggtgaaccccccctacggcagcagctacctgatcgtgggcaccggcgacgacaagctggtgtaccagtggaagaagagcggcagcagcatcggcaagctgttcagcgagaccgtgaagggcgcccagagaatggccatcgtgggcagcagcagctgggacttcagcagcgccggcggcttcttcagcagcgtgggcaaggccctgcacaccgtgttcggcaccgccttccagggcatcttcggcggcctgagctggatcaccagagtgctgatcggcgtgctgctgatctggctgggcctgaacagcagaaacggcatggccaccaccgtgatgatgatcaccggcttcgtgatcctgttcctgagcctgggcgtgggcgccgagatcggctgcagcgtgaactggggccag

SEQ ID NO: 806 - RNA, 2091 nt, synthetic construct
  misc_feature 1..2091: note = derived and/or modified CDS sequence (opt4) from YFV__KU921608__X-SS-prME-XX
  source 1..2091: mol_type = other RNA
atgagaggcctggccagcagaaagagaagaagcaacgagatggccctgttccccctgctgctgctgggcctgctggccctgagcggcggcgtgaccctggtgagaaagaacagatggctgctgctgaacgtgaccgccgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcagatgcgacgccgtgggcagaagcaagagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcaacaacaccacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctgcagaccgtggccatcgacggccccgccgaggccagaaaggtgtgctacagcgccgtgctgacccacgtgaagatcaacgacaagtgccccagcaccggcgaggcccacctggccgaggagaacgacggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggacagctggatcgtggacagacagtgggcccaggacctgaccctgccctggcagagcggcagcggcggcatctggagagagatgcaccacctggtggagttcgagcccccccacgccgccaccatcagagtgctggccctgggcaaccaggagggcagcctgaagaccgccctgaccggcgccatgagagtgaccaaggacgagaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccgtgaacttcggcaag

SEQ ID NO: 807 - RNA, 2091 nt, synthetic construct
  misc_feature 1..2091: note = derived and/or modified CDS sequence (opt4) from YFV__KX010994__X-SS-prME-XX
  source 1..2091: mol_type = other RNA
atgagaggcctgagcagcagaaagagaagaagcaacgagatggccatgttccccctgctgctgctgggcctgctggccctgagcggcggcgtgaccctggtgagaaagaacagatggctgctgctgaacgtgaccgccgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcagatgcgacgccgtgggcagaagcaagagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcaacaacaccacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctgcagaccgtggccatcgacggccccgccgaggccagaaaggtgtgctacagcgccgtgctgacccacgtgaagatcaacgacaagtgccccagcaccggcgaggcccacctggccgaggagaacgacggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggacagctggatcgtggacagacagtgggcccaggacctgaccctgccctggcagagcggcagcggcggcatctggagagagatgcaccacctggtggagttcgagcccccccacgccgccaccatcagagtgctggccctgggcaaccaggagggcagcctgaagaccgccctgaccggcgccatgagagtgaccaaggacgagaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccgtgaacttcggcaag

SEQ ID NO: 808 - RNA, 2091 nt, synthetic construct
  misc_feature 1..2091: note = derived and/or modified CDS sequence (opt4) from YFV__KX027336__X-SS-prME-XX
  source 1..2091: mol_type = other RNA
atgagaggcctggccagcagaaagagaagaagcaacgagatggccatggtgcccctgctgctgctgggcctgctggccctgagcggcggcgtgaccctggtgagaaagaacagatggctgctgctgaacgtgaccgccgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcagatgcgacgccgtgggcagaagcaagagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcaacaacaccacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctgcagaccgtggccatcgacggccccgccgaggccagaaaggtgtgctacagcgccgtgctgacccacgtgaagatcaacgacaagtgccccagcaccggcgaggcccacctggccgaggagaacgacggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggacagctggatcgtggacagacagtgggcccaggacctgaccctgccctggcagagcggcagcggcggcatctggagagagatgcaccacctggtggagttcgagcccccccacgccgccaccatcagagtgctggccctgggcaaccaggagggcagcctgaagaccgccctgaccggcgccatgagagtgaccaaggacgagaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccgtgaacttcggcaag

SEQ ID NO: 809 - RNA, 2091 nt, synthetic construct
  misc_feature 1..2091: note = derived and/or modified CDS sequence (opt4) from YFV__JX898868__X-SS-prME-XX
  source 1..2091: mol_type = other RNA
atgagaggcctgagcagcagaaagagaagaagccacgacgccctggccgtgcagttcctgatcctgggcatgctgctgatggccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgatgcagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 810 - RNA, 2091 nt, synthetic construct
  misc_feature 1..2091: note = derived and/or modified CDS sequence (opt4) from YFV__JX898869__X-SS-prME-XX
  source 1..2091: mol_type = other RNA
atgagaggcctgagcagcagaaagagaagaagccacgacgtgctgaccgtgcagttcctgatcctgggcatgctgctgatggccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcatcggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 811 - RNA, 2091 nt, synthetic construct
  misc_feature 1..2091: note = derived and/or modified CDS sequence (opt4) from YFV__JX898873__X-SS-prME-XX
  source 1..2091: mol_type = other RNA
atgagaggcctgagcagcagaaagagaagaagccacgacgccctgaccgtgcagctgctgatcctgggcatgatcctgatggccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccaccagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 812 - RNA, 2091 nt, synthetic construct
  misc_feature 1..2091: note = derived and/or modified CDS sequence (opt4) from YFV__JX898874__X-SS-prME-XX
  source 1..2091: mol_type = other RNA
atgagaggcctgagcagcagaaagagaagaagccacgacgccctgaccgtgcagctgctgatcctgggcatgatcctgatggccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 813 - RNA, 2091 nt, synthetic construct
  misc_feature 1..2091: note = derived and/or modified CDS sequence (opt4) from YFV__JX898875__X-SS-prME-XX
  source 1..2091: mol_type = other RNA
atgagaggcctgagcagcagaaagagaagaagccacgacgccctgaccgtgcagctgctgatcctgggcatgatcctgatggccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacggccccgccgaggccagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccaagttcaccggctacggcaaggccaccctggagtgccaggtgcagaccgccgtggacttcggcaacagctacatcgccgagatggagaaggagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 814 - RNA, 2091 nt, synthetic construct
  misc_feature 1..2091: note = derived and/or modified CDS sequence (opt4) from YFV__JX949181__X-SS-prME-XX
  source 1..2091: mol_type = other RNA
atgagaggcctgagcagcagaaagagaagaagccacgacgtgctgaccgtgcagttcctgatcctgggcatgctgctgatgaccggcggcgtgaccctggtgagaaagaacagatggctgctgctgaacgtgaccagcgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcaagtgcgacagcgccggcagaagcagaagaagcagaagagccatcgacctgcccacccacgagaaccacggcctgaagaccagacaggagaagtggatgaccggcagaatgggcgagagacagctgcagaagatcgagagatggttcgtgagaaaccccttcttcgccgtgaccgccctgaccatcgcctacctggtgggcagcaacatgacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctggagaccgtggccatcgacagacccgccgaggtgagaaaggtgtgctacaacgccgtgctgacccacgtgaagatcaacgacaagtgccccagcaccggcgaggcccacctggccgaggagaacgagggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaccaccgacatcaagaccctgaagttcgacgccctgagcggcagccaggaggtggagttcatcggctacggcaaggccaccctggagtgccaggtgcagaccgccgtggacttcggcaacagctacatcgccgagatggagaccgagagctggatcgtggacagacagtgggcccaggacctgaccctgccctggcagagcggcagcggcggcgtgtggagagagatgcaccacctggtggagttcgagcccccccacgccgccaccatcagagtgctggccctgggcaaccaggagggcagcctgaagaccgccctgaccggcgccatgagagtgaccaaggacaccaacgacaacaacctgtacaagctgcacggcggccacgtgagctgcagagtgaagctgagcgccctgaccctgaagggcaccagctacaagatctgcaccgacaagatgttcttcgtgaagaaccccaccgacaccggccacggcaccgtggtgatgcaggtgaaggtgagcaagggcgccccctgcagaatccccgtgatcgtggccgacgacctgaccgccgccatcaacaagggcatcctggtgaccgtgaaccccatcgccagcaccaacgacgacgaggtgctgatcgaggtgaacccccccttcggcgacagctacatcatcgtgggcagaggcgacagcagactgacctaccagtggcacaaggagggcagcagcatcggcaagctgttcacccagaccatgaagggcgtggagagactggccgtgatgggcgacaccgcctgggacttcagcagcgccggcggcttcttcaccagcgtgggcaagggcatccacaccgtgttcggcagcgccttccagggcctgttcggcggcctgaactggatcaccaaggtgatcatgggcgtggtgctgatctgggtgggcatcaacaccagaaacatgaccatgagcatgagcatgatcctggtgggcgtgatcatgatgttcctgagcctgggcgtgggcgccgaccagggctgcgccatcaacttcggcaag

SEQ ID NO: 815 - RNA, 2091 nt, synthetic construct
  misc_feature 1..2091: note = derived and/or modified CDS sequence (opt4) from YFV__AY968064__X-SS-prME-XX
  source 1..2091: mol_type = other RNA
atgagaggcctgagcagcagaaagagaagaagcaacgagatggccctgttccccctgctgctgctgggcctgctggccctgagcggcggcgtgaccctggtgagaaagaacagatggctgctgctgaacgtgaccgccgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcagatgcgacgccgtgggcagaagcaagagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcaacaacaccacccagagagtggtgatcgccctgctggtgctggccgtgggccccgcctacagcgcccactgcatcggcatcaccgacagagacttcatcgagggcgtgcacggcggcacctgggtgagcgccaccctggagcaggacaagtgcgtgaccgtgatggcccccgacaagcccagcctggacatcagcctgcagaccgtggccatcgacggccccgccgaggccagaaaggtgtgctacagcgccgtgctgacccacgtgaagatcaacgacaagtgccccagcaccggcgaggcccacctggccgaggagaacgacggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggacagctggatcgtggacagacagtgggcccaggacctgaccctgccctggcagagcggcagcggcggcatctggagagagatgcaccacctggtggagttcgagcccccccacgccgccaccatcagagtgctggccctgggcaaccaggagggcagcctgaagaccgccctgaccggcgccatgagagtgaccaaggacgagaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgccgagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccgtgaacttcggcaag

SEQ ID NO: 816 - RNA, 2091 nt, synthetic construct
  misc_feature 1..2091: note = derived and/or modified CDS sequence (opt4) from YFV__AY968065__X-SS-prME-XX
  source 1..2091: mol_type = other RNA
atgagaggcctgagcagcagaaagagaagaagcagcgagatgaccatgatgcccctgctgatcctgagcatggtgatcctgggcggcggcgtgaccctggtgagaaagaacagatggctgctgctgaacgtgaccgccgaggacctgggcaagaccttcagcgtgggcaccggcaactgcaccaccaacatcctggaggccaagtactggtgccccgacagcatggagtacaactgccccaacctgagccccagagaggagcccgacgacatcgactgctggtgctacggcgtggagaacgtgagagtggcctacggcagatgcgacgccgtgggcagaagcaagagaagcagaagagccatcgacctgcccacccacgagaaccacggcctgaagaccagacaggagaagtggatgaccggcagaatgggcgagagacagctgcagaagatcgagagatggctggtgagaaaccccttcttcgccgtgaccgccctggccatcgcctacctggtgggcaacaacaagacccagagagtggtgatcgccctgctggtgctggccgtgggccccgcctacagcgcccactgcatcggcatcaccgacagagacttcatcgagggcgtgcacggcggcacctgggtgagcgccagcctggagcaggacaagtgcgtgaccgtgatggcccccgacaagcccagcctggacatcagcctgcagaccgtggccatcgacggccccgccgaggccagaaaggtgtgctacagcgccgtgctgacccacgtgaagatcaacgacaagtgccccagcaccggcgaggcccacctggccgaggagaacgacggcgacaacgcctgcaagagaacctacagcgacagaggctggggcaacggctgcggcctgttcggcaagggcagcatcgtggcctgcgccaagttcacctgcgccaagagcatgagcctgttcgaggtggaccagaccaagatccagtacgtgatcagagcccagctgcacgtgggcgccaagcaggagaactggaacaccgacatcaagaccctgaagttcgacgccctgagcggcagccaggaggccgagttcaccggctacggcaaggccaccctggagtgccaggtgcagaccgccgtggacttcggcaacagctacatcgccgagatggagaaggacagctggatcgtggacagacagtgggcccaggacctgaccctgccctggcagagcggcagcggcggcatctggagagagatgcaccacctggtggagttcgagcccccccacgccgccaccatcagagtgctggccctgggcaaccaggagggcagcctgaagaccgccctgaccggcgccatgagagtgaccaaggacgagaacgacaacaacctgtacaagctgcacggcggccacgtgagctgcagagtgaagctgagcgccctgaccctgaagggcaccagctacaagatgtgcaccgacaagatgagcttcgtgaagaaccccaccgacaccggccacggcaccgtggtgatgcaggtgaaggtgcccaagggcgccccctgcaagatccccgtgatcgtggccgacgacctgaccgccgccgtgaacaagggcatcctggtgaccgtgaaccccatcgccagcaccaacgacgacgaggtgctgatcgaggtgaacccccccttcggcgacagctacatcatcgtgggcaccggcgacagcagactgacctaccagtggcacaaggagggcagcagcatcggcaagctgttcacccagaccatgaagggcgtggagagactggccgtgatgggcgacgccgcctgggacttcagcagcgccggcggcttcttcaccagcgtgggcaagggcatccacaccgtgttcggcagcgccttccagggcctgttcggcggcctgagctggatcaccaaggtgatcatgggcgccgtgctgatctgggtgggcatcaacaccagaaacatgaccatgagcatgagcatgatcctggtgggcgtgatcatgatgttcctgagcctgggcgtgggcgccgaccagggctgcgccgtgaacttcggcaag

SEQ ID NO: 817 - RNA, 2061 nt, synthetic construct
  misc_feature 1..2061: note = derived and/or modified CDS sequence (opt5) from YFV__L06480__X-SS-prME-XX
  source 1..2061: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccccaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagctcgcaaagtgtgctacaacgccgttctgacacatgtgaagattaatgacaaatgtccctctaccggcgaggcgcaccttgccgaagagaacgaaggcgacaatgcttgcaagcggacctattccgatagagggtggggaaacggctgtgggctgttcggaaagggcagcatcgtcgcctgcgctaaatttacatgcgccaagtctatgtccctcttcgaggtggaccagacgaaaattcagtacgttatccgcgcccagctgcacgtgggggctaagcaagagaattggaacaccagcatcaaaacacttaagtttgatgcgctgtccggatctcaggaagtcgagttcattggctacggcaaagccaccctcgaatgtcaggtgcagacagctgtcgactttgggaacagctatatcgccgagatggaaaccgagtcctggattgtggatcggcaatgggcccaggacctgacgctgccttggcagagcggatctggcggggtttggagagagatgcatcacctcgtggagttcgagccccctcatgctgccacaatccgcgtcctggcgcttggaaatcaagaaggctccctgaagaccgctctcaccggggccatgcgggtgacaaaggataccaacgacaataacctgtacaaacttcacggcggacacgttagctgcagagtgaagctgtctgccctcacactgaaaggcacgagctataagatttgtaccgataaaatgtttttcgtcaagaatcccacagacaccgggcatggaacagtggtgatgcaggttaaggtcccgaaaggcgctccttgccgcatccccgtgatcgtggccgatgacctgaccgctgccattaacaaggggatcctcgtcacggtgaatcctattgcgtccaccaacgacgatgaggttctgatcgaagtgaatcctcccttcggagactcttacattatcgtcggccggggagatagcagacttacatatcagtggcacaaagagggctccagcatcggaaagctgtttacccagacaatgaaaggcgtggagcgcctcgccgttatgggggacgtggcttgggatttctcttccgccggaggctttttcaccagcgtcgggaaggggattcatacggtgtttggctctgctttccaagggctgtttggcggactgaactggatcacaaaggttattatgggcgccgtgcttatctgggtcgggattaatacccggaacatgacaatgtccatgagcatgatcctcgtgggagtgattatgatgttcctgtccctgggcgtcggggcg

SEQ ID NO: 818 - RNA, 2091 nt, synthetic construct
  misc_feature 1..2091: note = derived and/or modified CDS sequence (opt5) from YFV__D14458__X-SS-prME-XX
  source 1..2091: mol_type = other RNA
atgagaggcctgagctcccggaagcgcagatcttacgaggtgctcaccgtccagttcctgatccttgggatgctgctcatgacaggaggcgttacgctggtgcggaaaagccgctggcttctgctcaacgtgacctccgaagacctggggaagacattttctgtcggaaccggcaattgcacaaccaacattctggaggccaaaaattggtgtcccgatagcatggaatataactgccccaatctctccccgagagaggaacccgacgatatcgactgttggtgctacggggtggagaacgttcgggtggcttatggaaagtgtgattctgccggccgcagcagacggtcccgcagagcgattgacctgcctacacacgagaatcatggccttaaaacccggcaagaaaagtggatgacggggcgcatgggagagagacagctgcagaagatcgaacggtggctcgtccgcaaccccttctttgctgtgaccgccctggccattgcttaccttgttggcagcaatatgacacagagagtggtcatcgccctgctcgtgctggctgtggggcctgcctattctgcgcactgcatcggaattaccgatcgggacttcatcgagggcgtccatgggggaacatgggtttccgccaccctggagcaagataaatgtgtgacggtgatggctcccgacaagcctagcctcgatatttctctggaaacagtcgccatcgacggcccggctgaggccagaaaagtgtgctactccgcggttcttacccacgtgaagattaacgataaatgtcccagcacaggcgaagcccatctggctgaggaaaatgagggggaccacgcctgcaagcgcacctattctgaccggggatggggcaacgggtgtggactctttggcaaggggtccatcgtcgcttgcgccaaatttacctgcgccaagagcatgtccctgttcgaggtggatcagacaaaaattcagtacgttatcagagctcagcttcacgtgggagcgaagcaagaaaattggaacgccgacatcaaaacgctgaagttcgatgctctctctggcagccaggaggccgaatttaccggctacgggaaagccacactggagtgtcaggtccagaccgctgtggacttctccaatagctatattgccgaaatggagaaggagtcttggatcgtcgatcgccaatgggcgcaggacctgacactcccttggcagtccggaagcggcggggtgtggcgggaaatgcatcacctggttgagtttgaaccccctcatgctgccaccattaaggtgcttgccctgggaaaccaagagggctctctcaaaacggctctgacaggggccatgagagtcaccaaggataccaacggcagcaatctttacaaactgcacggaggccacgtgtcctgccgcgttaagctctctgctctgacactgaaagggaccagctataagatgtgtacagacaagatgtccttcgtgaaaaaccccacggataccggacatggcacagccgtcatgcaagtgaaggtgccgaaaggggcgccttgccggatccccgttatggtcgccgacgatctcaccgctagcgtgaataagggcattctggtgacagtcaaccctatcgcctctaccaatgaagacgaggtgcttatcgaggttaaccctccctttggagactcctacattatcgtggggacgggcgatagcagactgacctatcagtggcacaaagaaggatcttccattggcaaactcttcacacagaccatgaagggggctgagcgcctggccgtcatgggagacgcggcctgggatttcagctccgctggcgggtttttcacatctgtgggaaagggcatccatatggtttttgggagcgccttccagggcctgtttggaggcctttcctggattaccaaggtgatcatgggggctgtcctcatctgggtgggaattaatatgcggaacatgacgatgtctatgagcatgatcctggttggcgtgattatgatgttcctgtccctcggggtcggagccgaccagggctgtgccatcaattttgggaaa

SEQ ID NO: 819 - RNA, 2091 nt, synthetic construct
  misc_feature 1..2091: note = derived and/or modified CDS sequence (opt5) from YFV__U21055__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccatgggaaccggcaactgcacaaccaatattctggaagccaaatactggtgtcccgactctatggagtataactgccccaatctcagcccgagagaagaacccgatgacatcgattgttggtgctacggggtcgaaaacgtgcgggttgcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtgcgcaacccctttttcgctgtcaccgccctcacaattgcctacctggtgggctccaatatgacccagagagttgtgatcgcccttctggtcctcgctgtggggcctgcttatagcgcccattgcatcggaattacagaccgggattttatcgaaggcgtgcacgggggaacctgggtctctgcgacgctggagcaagacaaatgtgttacagtgatggcccccgataagccttccctggacattagcctcgagaccgtggctatcgatggcccggtcgaagccagaaaagtgtgctacaacgctgttctgacacatgtgaagattaatgacaaatgtccctctaccggcgaggcccaccttgcggaagagaacgaaggggacaatgcctgcaagcgcacctattccgatcggggatggggcaacgggtgtggactgttcggcaaggggagcatcgtcgcttgcgccaaatttacatgcgctaagtctatgtccctcttcgaggtggaccagacgaaaattcagtacgttatcagagcccgcctgcacgtgggagccaagcaggagaattggaaaaccgatatcaagacacttaaatttgacgctctgagcggctcccaagaagcggagttcaccggctacgggaaggccacactcgaatgtcaggtccagaccgctgtggattttggaaactcttatattgccgagatggaaaaggagagctggatcgtcgaccggcagtgggcccaagatctgacgctgccttggcagtccggcagcgggggagtgtggagagagatgcatcacctcgttgagttcgagccccctcatgctgccacaattcgcgtgctggcgcttggcgaccaggaagggtctctgaaaaccgctctcaccggcgccatgcgggtcacaaaggataccaacgacaataacctgtacaaacttcacggaggccacgtgtcctgcagagttaagctgagcgccctcacactgaaagggacgtcttataagatgtgtaccgataagatgagctttgtgaaaaatcccacagacaccggacatggcacagtcgtgatgcaagtgaaggttccgaaaggggctccttgccgcatccccgtcattgtggccgacgatctgaccgctgccatcaacaagggaatcctcgtgacggtcaatcctattgcgtccaccaacgacgatgaggtgctgatcgaagttaatcctcccttcggcgactcttacattatcgtggggacaggcgatagccggcttacctatcagtggcacaaagagggatccagcattggcaagctgttcacacagaccatgaagggggccgagagactcgctgtcatgggagacgccgcttgggatttttcttccgccggcgggttctttacgagcgtgggaaaaggcatccatacagttttcgggtctgcgtttcagggcctgttcggaggcctgaactggatcaccaaggtgattatcggggccgtccttatttgggtgggaatcaatacacgcaacatgaccatgtccatgagcatgattctcgttggcgtgatcatgatgtttctgtccctgggggtcggagctgaccaaggctgtgccattaatttcgctaaa

SEQ ID NO: 820 - RNA, 2091 nt, synthetic construct
  misc_feature 1..2091: note = derived and/or modified CDS sequence (opt5) from YFV__U21056__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccccaatctcagcccgagagaggaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggctcgtccgcaaccccttctttgctgtgaccgccctgacaattgcctaccttgttggctccaatatgacccagagagtggtcatcgctctgctcgtgctggccgtggggcctgcttatagcgcccattgcatcggaattacagaccgggatttcatcgaaggcgtccacgggggaacctgggtttctgcgacgctggagcaagacaaatgtgtgacagtgatggcccccgataagccttccctcgacattagcctggagaccgtcgctatcgatggcccggccgaagctagaaaagtgtgctacaacgccgttcttacacatgtgaagattaatgacaaatgtccctctaccggcgaggcgcacctggccgaagagaacgaaggggacaatgcttgcaagcgcacctattccgatcggggatggggcaacgggtgtggactctttggcaaggggagcatcgtcgcctgcgctaaattcacatgcgccaagtctatgtccctgtttgaggtggaccagacgaaaattcagtacgttatcagagcccagcttcacgtgggagctaagcaagagaattggaacaccgatatcaaaacactgaagttcgacgcgctcagcggctcccaggaagccgagtttaccggctacgggaaagctacactggaatgtcaggtccagaccgccgtggatttcggaaactcttatattgccgagatggaaaaggagagctggatcgtcgaccgccaatgggctcaggatctgacgctcccttggcagtccggcagcgggggagtgtggcggggcatgcatcacctggttgagtttgaaccccctcatgccgcgacaattagagtgcttgctctggggaatcaagagggctctctcaagaccgccctgaccggagccatgcgcgtcacaaaagacaccaacgataataacctttacaagctgcacggcgggcacgtgtcctgccgggttaaactcagcgctctgacactgaagggaacgtcttataaaatgtgtaccgacaagatgagcttcgtgaagaatcccacagataccggccatgggacagtcgtgatgcaagtgaaagttccgaagggagccccttgcagaatccccgtcattgtggctgacgacctcaccgccgcgatcaacaaaggcatcctggtgacggtcaatcctattgcctccaccaacgatgacgaagtgcttatcgaggttaatcctccctttggggattcttacattatcgtgggcacaggagacagccgcctgacctatcagtggcacaaggaaggctccagcattgggaaactcttcacacagaccatgaagggagtcgagcggctggctgtgatgggcgatgccgcttgggacttctcttccgccgggggatttttcacgagcgttggcaaggggatccatacagtgtttggctctgcgttccagggactgtttggcgggcttaactggatcaccaaagtcattatgggagccgtgctcatctgggttggcattaatacaagaaacatgaccatgtccatgagcatgatcctggtgggggtcattatgatgttcctgtccctcggagtgggcgctgatcaggggtgtgccatcaattttggcaag

SEQ ID NO: 821 - RNA, 2091 nt, synthetic construct
  misc_feature 1..2091: note = derived and/or modified CDS sequence (opt5) from YFV__U54798__X-SS-prME-XX
  source 1..2091: mol_type = other RNA
atgagaggcctgagctcccggaagcgcagatctcacgacgtgctcaccgtccagttcctgatccttgggatgctgctcatggccggaggcgttacactggtgcggaaaaaccgctggcttctgctcaatgtgacgagcgaggatctggggaagaccttttccgtcggaacaggcaactgcaccacaaatattctggaagctaaatactggtgtcccgactctatggagtataactgccccaatctcagcccgagagaggaacccgatgacatcgattgttggtgctacggggtggaaaacgttcgggtggcctatggaaagtgtgactccgcgggccgctctagacggagccgcagagctattgatctgcctacccatgagaatcacggccttaaaacacggcaagagaagtggatgaccgggcgcatgggagaaagacagctgcagaagatcgagcggtggctcgtccgcaaccccttctttgccgtgacggccctggctattgcctaccttgttggctccaatatgacccagagagtggtcatcgctctgctcgtgctggccgtggggcctgcgtatagcgcccattgcatcggaattacagaccgggatttcatcgaaggcgtccacgggggaacctgggtttctgctacactggagcaagacaaatgtgtgaccgtgatggcccccgataagccttccctcgacattagcctggagacggtcgctatcgatggcccggccgaagcgagaaaagtgtgctacaacgccgttcttacacatgtgaagattaatgacaaatgtccctctaccggcgaggctcacctggccgaagagaacgaaggggacaatgcttgcaagcgcacatattccgatcggggatggggcaacgggtgtggactctttggcaaggggagcatcgtcgcctgcgccaaatttacctgcgctaagtctatgtccctgttcgaggtggaccagaccaaaattcagtacgttatcagagcgcagcttcacgtgggagccaagcaagagaattggaacacagatatcaaaacgctgaagttcgacgctctcagcggctcccaggaagccgagtttaccggctacgggaaagccacactggaatgtcgcgtccagaccgctgtggatttcggaaactcttatattgccgagatggaaaaggagagctggatcgtcgaccggcagtgggcgcaagatctgacactcccttggcagtccggcagcgggggagtgtggagagagatgcatcacctggttgaatttgagccccctcatgctgccaccattcgcgtgcttgccctgggcaatcaggaagggtctctcaagacggctctgacaggcgccatgcgggtcaccaaagacaccaacgataataacctttacaagctgcacggaggccacgtgtcctgcagagttaaactcagcgctctgacactgaaggggacctcttataaaatgtgtacagacaagatgagcttcgtgaagaatcccacggataccgaccatggaacagtcgtgatgcaagtgaaagttccgaagggcgccccttgcaaaatccccgtcattgtggcggacgatctcaccgccgctatcaacaaggggatcctggtgacagtcaatcctattgcctccaccaacgacgatgaggtgcttatcgaagttaatcctccctttggagactcttacattatcgtgggcacgggggatagccgcctgacctatcagtggcacaaagagggctccagcattggaaaactcttcacacagaccatgaagggcgctgagcggctggccgtcatgggggacgcggcctgggatttctcttccgctggaggcctgtttacaagcatcgggaagggatctcataccgtgttcggctccgcctttcaggggcttttcggcggactcagctggatcacgaaggttattatgggcgctgtgctgatctgggtcgggattaacacaagaaatatgaccatgtccatgtctatgatcctggtgggagttattatgatgtttctcagcctgggcgtgggggccgaccaaggatgtgccatcaacttcggcaaa

SEQ ID NO: 822 - RNA, 2061 nt, synthetic construct
  misc_feature 1..2061: note = derived and/or modified CDS sequence (opt5) from YFV__AF052440__X-SS-prME-XX
  source 1..2061: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaccacagatatcaaaacccttaagtttgacgctctgagcggatcccaggaagtggagttcattggctacggcaaagcgacactcgaatgtcaggtccagaccgccgtggattttgggaactcttatatcgctgagatggaaacggagagctggattgttgaccggcaatgggcccaggatctgacactgccttggcagtccggaagcggcggggtgtggagagagatgcatcacctcgtcgagttcgagccccctcatgccgctaccatccgcgtgctggcccttggaaaccaagaaggctctctgaagaccgcgctcacaggggctatgcgggttaccaaggacacaaatgataacaatctgtacaaacttcacggcggacacgtgtcctgcagagtcaagctgagcgccctcacgctgaaaggcacctcttataagatttgtacagacaaaatgtttttcgtgaagaaccccaccgatacagggcatggaaccgtggttatgcaggtcaaggtgagcaaaggcgccccgtgccgcatccctgtgatcgtcgctgacgacctgacggccgctattaataaggggatcctcgtgaccgttaaccccattgcctccacaaatgatgacgaggtgctgatcgaagtcaaccctcccttcggagattcttacattatcgtgggccggggagacagcagacttacctatcagtggcacaaagagggctccagcatcggaaagctgtttacacagaccatgaaaggcgttgagcgcctcgcggtgatgggggatacggcctgggacttctcttccgctggaggctttttcacaagcgtcgggaaggggattcataccgtgtttggctctgccttccaagggctgtttggcggactgaattggatcacaaaggttattatgggcgctgtgcttatctgggtcgggattaacacccggaatatgaccatgtccatgagcatgatcctcgtgggagtgattatgatgttcctgtccctgggcgtcggggcc

SEQ ID NO: 823 - RNA, 2091 nt, synthetic construct
  misc_feature 1..2091: note = derived and/or modified CDS sequence (opt5) from YFV__AF052445__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaacaccgatatcaaaacacttaagtttgacgctctgagcggatcccaggaagtggagttcattggctacggcaaagcgaccctcgaatgtcaggtccagacagccgtggattttgggaactcttatatcgctgagatggaaaccgagagctggattgttgaccggcaatgggcccaggatctgacgctgccttggcagtccggaagcggcggggtgtggagagagatgcatcacctcgtcgagttcgagccccctcatgccgctacaatccgcgtgctggcccttggaaatcaagaaggctctctgaagaccgcgctcaccggggctatgcgggttacaaaggacaccaacgataataacctgtacaaacttcacggcggacacgtgtcctgcagagtcaagctgagcgccctcacactgaaaggcacgtcttataagatttgtaccgacaaaatgtttttcgtgaagaatcccacagataccgggcatggaacagtggttatgcaggtcaaggtgagcaaaggcgccccgtgccgcatccctgtgatcgtcgctgacgacctgaccgccgctattaacaaggggatcctcgtgacggttaatcccattgcctccaccaacgatgacgaggtgctgatcgaagtcaatcctcccttcggagattcttacattatcgtgggccggggagacagcagacttacatatcagtggcacaaagagggctccagcatcggaaagctgtttacccagacaatgaaaggcgttgagcgcctcgcggtgatgggggataccgcctgggacttctcttccgctggaggctttttcacgagcgtcgggaaggggattcatacagtgtttggctctgccttccaagggctgtttggcggactgaactggatcaccaaggttattatgggcgtggtccttatctgggtggggattaatacacggaacatgaccatgtccatgagcatgatcatggtgggagtcattatgatgttcctctccctgggcgttggggctgatcagggatgtgccatcaattttggcaaa

SEQ ID NO: 824 - RNA, 2091 nt, synthetic construct
  misc_feature 1..2091: note = derived and/or modified CDS sequence (opt5) from YFV__AF094612__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctgatgcggaaaaaccgctggcttctgctcaatgtgaccagcgaggatctggggaagacattttccattggaaccggcaactgcacaaccaatatcctggaagccaaatactggtgtcccgactctatggagtataactgccccaatctcagcccgagagaagaacccgatgacattgattgttggtgctacggggtggaaaacgtccgggtgacatatggaaagtgtgactccgctggccgctctagacggagccgcagagccatcgatctgcctacccatgagaatcacggccttaaaacgcggcaagagaagtggatgaccgggcgcatgggagaaagacagctgcagaagattgagcggtggttcgttcgcaacccctttttcgcggtgacagctctcaccatcgcctacctggtcggctccaatatgacacagagagtggttatcgcccttctggtgctcgctgtcgggcctgcctatagcgctcattgcattggagtggccgaccgggattttatcgaaggcgtgcacgggggaacctgggtctctgcgacgctggagcaagacaaatgtgttacagtgatggcccccgataagccttccctggacattagcctcgagaccgtggctatcgatggcccggtcgaagccagaaaagtgtgctacaacgctgttctgacacatgtgaagattgacgacaaatgtccctctaccggcgaggcccaccttgcggaagagaatgaaggggataacgcctgcaagcgcacctattccgaccggggatggggcaatgggtgtggactgttcggcaaggggagcatcgtcgcttgcgccaaatttacatgcgctaagtctatgtccctcttcgaggtggatcagacgaaaattcagtacgttatcaaggcccagctgcacgtgggagccaaacaagaggactggaagaccgatatcaaaacacttaagtttgacgtcctgagcggctcccaggaagctgagttcaccggctacgggaaggtgacactcgaatgtcaggtccagaccgcggtggattttggaaactcttatattgccgagatggaaaaagagagctggatcgttgacagacaatgggctcaggatctgacgctgccttggcagtccggcagcgggggagtgtggcgcgagatgcatcacctcgtcgagttcgagccccctcatgccgccacaattcgggtgctggctcttggcgaccaagaagggtctctgaagaccgccctcaccggcgcgatgagagttacaaaagataccaatgacaacaacctgtacaaacttcacggaggccacgtgtcctgccgcgtcaagctgagcgctctcacactgaaggggacgtcttataagatgtgtaccgacaaaatgagctttgtgaagaatcccacagataccggacatggcacagtggttatgcaggtcaaagtgccgaagggggccccttgcaaaatccccgtgattgtcgccgacgatctgaccgctgccatcaacaagggaatcctcgtgacggttaatcctattgcttccaccaacgacgatgaggtgctgatcgaagtcaatcctcccttcggcgactcttacattatcattgggacaggcgatagccggcttacctatcagtggcacaaggagggatccagcatcggcaaactgttcacacagaccatgaagggggccgagagactcgcggtgatgggagacgccgcttgggatttttcttccgccggcgggttctttacgagcgttggaaaaggcatccatacagtgttcgggtctgcttttcaaggcctgttcggaggcctgaactggattaccaaggtcatcatgggggccgtgcttatttgggttggatttaatacacgcaacatgaccatgtccatgagcatgatcctcgtgggcgtcattatgatgttcctgtccctgggggtgggagcggaccagggctgtgccatcaattttgggaaa

SEQ ID NO: 825 - RNA, 2091 nt, synthetic construct
  misc_feature 1..2091: note = derived and/or modified CDS sequence (opt5) from YFV__KF769015__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaccacagatatcaaaacccttaagtttgacgctctgagcggatcccaggaagtggagttcattggctacggcaaagcgacactcgaatgtcaggtccagaccgccgtggattttgggaactcttatatcgctgagatggaaacggagagctggattgttgaccggcaatgggcccaggatctgacactgccttggcagtccggaagcggcggggtgtggagagagatgcatcacctcgtcgagttcgagccccctcatgccgctaccatccgcgtgctggcccttggaaaccaagaaggctctctgaagaccgcgctcacaggggctatgcgggttaccaaggacacaaatgataacaatctgtacaaacttcacggcggacacgtgtcctgcagagtcaagctgagcgccctcacgctgaaaggcacctcttataagatttgtacagacaaaatgtttttcgtgaagaaccccaccgatacagggcatggaaccgtggttatgcaggtcaaggtgagcaaaggcgccccgtgccgcatccctgtgatcgtcgctgacgacctgacggccgctattaataaggggatcctcgtgaccgttaaccccattgcctccacaaatgatgacgaggtgctgatcgaagtcaaccctcccttcggagattcttacattatcgtgggccggggagacagcagacttacctatcagtggcacaaagagggctccagcatcggaaagctgtttacacagaccatgaaaggcgttgagcgcctcgcggtgatgggggatacggcctgggacttctcttccgctggaggctttttcacaagcgtcgggaaggggattcataccgtgtttggctctgccttccaagggctgtttggcggactgaattggatcacaaaggttattatgggcgctgtgcttatctgggtcgggattaacacccggaatatgaccatgtccatgagcatgatcctcgtgggagtgattatgatgttcctgtccctgggcgtcggggccgatcagggatgtgcgatcaactttggcaaa

SEQ ID NO: 826 - RNA, 2091 nt, synthetic construct
  misc_feature 1..2091: note = derived and/or modified CDS sequence (opt5) from YFV__KF769016__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccccaatctcagcccgagagaggaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggctcgtccgcaaccccttctttgctgtgaccgccctgacaattgcctaccttgttggctccaatatgacccagagagtggtcatcgctctgctcgtgctggccgtggggcctgcttatagcgcccattgcatcggaattacagaccgggatttcatcgaaggcgtccacgggggaacctgggtttctgcgacgctggagcaagacaaatgtgtgacagtgatggcccccgataagccttccctcgacattagcctggagaccgtcgctatcgatggcccggccgaagctagaaaagtgtgctacaacgccgttcttacacatgtgaagattaatgacaaatgtccctctaccggcgaggcgcacctggccgaagagaacgaaggggacaatgcttgcaagcgcacctattccgatcggggatggggcaacgggtgtggactctttggcaaggggagcatcgtcgcctgcgctaaattcacatgcgccaagtctatgtccctgtttgaggtggaccagacgaaaattcagtacgttatcagagcccagcttcacgtgggagctaagcaagagaattggaacaccgatatcaaaacactgaagttcgacgcgctcagcggctcccaggaagccgagtttaccggctacgggaaagctacactggaatgtcaggtccagaccgccgtggatttcggaaactcttatattgccgagatggaaaaggagagctggatcgtcgaccgccaatgggctcaggatctgacgctcccttggcagtccggcagcgggggagtgtggcgggagatgcatcacctggttgaatttgagccccctcatgccgcgacaattagagtgcttgctctgggcaatcaagaagggtctctcaagaccgccctgaccggcgccatgcgcgtcacaaaagacaccaacgataataacctttacaagctgcacggaggccacgtgtcctgccgggttaaactcagcgctctgacactgaaggggacgtcttataaaatgtgtaccgacaagatgagcttcgtgaagaatcccacagataccggacatggcacagtcgtgatgcaagtgaaagttccgaagggggccccttgcaaaatccccgtcattgtggctgacgacctcaccgccgcgatcaacaagggaatcctggtgacggtcaatcctattgcctccaccaacgatgacgaggtgcttatcgaagttaatcctccctttggcgattcttacattatcgtggggacaggcgacagcagactgacctatcagtggcacaaagagggatccagcattggcaaactcttcacacagaccatgaagggggctgagcgcctggccgtcatgggagatgctgcctgggacttctcttccgcgggcgggtttttcacgagcgtgggaaagggcatccatacagtttttgggtctgccttccagggcctgtttggaggccttaactggatcaccaaggtgattatgggggctgtcctcatctgggtgggaattaatacacggaacatgaccatgtccatgagcatgatcctggttggcgtgattatgatgttcctgtccctcggggtcggagccgatcagggctgtgctatcaattttgggaaa

SEQ ID NO: 827 - RNA, 2091 nt, synthetic construct
  misc_feature 1..2091: note = derived and/or modified CDS sequence (opt5) from YFV__KF907504__X-SS-prME-XX
  source 1..2091: mol_type = other RNA
atgagaggcctgagctcccggaagcgcagatctcacgaggtgctcaccgtccagttcctgatccttgggatgctgctcatgacaggaggcgttacgctggtgcggaaaagccgctggcttctgctcaacgtgacctccgaagacctggggaagacattttctgtcggaaccggcaattgcacaaccaacattctggaggccaaaaattggtgtcccgatagcatggaatacaactgccccaatctctccccgagagaggaacccgacgatatcgactgttggtgctatggggtggagaacgttcgggtggcttacggaaagtgtgattctgccggccgcagcagacggtcccgcagagcgattgacctgcctacacatgagaatcacggccttaaaacccggcaagaaaagtggatgacggggcgcatgggagagagacagctgcagaagatcgaacggtggctcgtccgcaaccccttctttgctgtgaccgccctggccattgcttatcttgttggcagcaatatgacacagagagtggtcatcgccctgctcgtgctggctgtggggcctgcctactctgcgcattgcatcggaattaccgatcgggacttcatcgagggcgtccacgggggaacatgggtttccgccaccctggagcaagataaatgtgtgacggtgatggctcccgacaagcctagcctcgatatttctctggaaacagtcgccatcgacggcccggctgaggccagaaaagtgtgctattccgcggttcttacccatgtgaagattaacgataaatgtcccagcacaggcgaagcccacctggctgaggaaaatgagggggaccacgcctgcaagcgcacctactctgaccggggatggggcaacgggtgtggactctttggcaaggggtccatcgtcgcttgcgccaaatttacctgcgccaagagcatgtccctgttcgaggtggatcagacaaaaattcagtatgttatcagagctcagcttcatgtgggagcgaagcaagaaaattggaacgccgacatcaaaacgctgaagttcgatgctctctctggcagccaggaggccgaatttaccggctacgggaaagccacactggagtgtcaggtccagaccgctgtggacttctccaatagctacattgccgaaatggagaaggagtcttggatcgtcgatcgccaatgggcgcaggacctgacactcccttggcagtccggaagcggcggggtgtggcgggaaatgcaccatctggttgagtttgaaccccctcacgctgccaccattaaggtgcttgccctgggaaaccaagagggctctctcaaaacggctctgacaggggccatgagagtcaccaaggataccaacggcagcaatctttataaactgcacggaggccatgtgtcctgccgcgttaagctctctgctctgacactgaaagggaccagctacaagatgtgtacagacaagatgtccttcgtgaaaaaccccacggataccggacacggcacagccgtcatgcaagtgaaggtgccgaaaggggcgccttgccggatccccgttatggtcgccgacgatctcaccgctagcgtgaataagggcattctggtgacagtcaaccctatcgcctctaccaatgaagacgaggtgcttatcgaggttaaccctccctttggagactcctatattatcgtggggacgggcgatagcagactgacctaccagtggcataaagaaggatcttccattggcaaactcttcacacagaccatgaagggggctgagcgcctggccgtcatgggagacgcggcctgggatttcagctccgctggcgggtttttcacatctgtgggaaagggcatccacatggtttttgggagcgccttccagggcctgtttggaggcctttcctggattaccaaggtgatcatgggggctgtcctcatctgggtgggaattaatatgcggaacatgacgatgtctatgagcatgatcctggttggcgtgattatgatgttcctgtccctcggggtcggagccgaccagggctgtgccatcaattttgggaga

SEQ ID NO: 828 - RNA, 2091 nt, synthetic construct
  misc_feature 1..2091: note = derived and/or modified CDS sequence (opt5) from YFV__JF912179__X-SS-prME-XX
  source 1..2091: mol_type = other RNA
atgagaggcctgagctcccggaagcgcagatctcaggacgccctcaccgtgcaattcctgatccttgggatgctgctcatggtcggaggcgttacactggtgcggcgcaacagatggcttctgctcaatgtgacgagcgaggatctggggaaaaccttttccgtcggaacaggcaactgcaccacaaatattctggaagctaagtactggtgtcccgactctatggagtataactgccccaatctcagcccgcgggaggaacccgatgacatcgattgttggtgctacggggtggaaaacgttcgcgtggcctatggaaaatgtgactccgcgggcagatctcggcgcagcagacgggctattgatctgcctacccacgagaatcatggccttaagacacgccaggagaaatggatgaccgggagaatgggagaacggcagctgcagaagatcgagcgctggctcgtcagaaaccccttctttgccgccacggctctggccattgcttaccttgtgggctccaatatgacccaacgggttgtgatcgccctgctcgtcctggcggtggggcctgcctatagcgctcactgcatcggaattacagacagagatttcatcgaaggcgtgcatgggggaacctgggtctctgccacactggagcaggacaagtgtgttaccgtgatggctcccgataaaccttccctcgacattagcctggagacggtggccatcgatggcccggcggaagcccgcaaggtctgctactctgctgtgcttacaaacgttaaaattaatgacaagtgtccctccaccggcgaggcccacctggaagaggaaaacgagggggacaatgcttgcaaacggacatatagcgatagaggatggggcaacgggtgtggactctttggcaaggggtctatcgtggcctgcgccaagtttacctgcgctaaatccatgagcctgttcgaggtcgaccagaccaagattcagtacgtgatccgcgcgcaacttcatgttggagccaaacaggaaaattggaacacagatatcaagacgctgaaattcgacgctctctccggctctcaggaggccgaatttaccggctacgggaaggccacactggagtgtcaggtgcaaaccgctgtcgatttcagcaactcctatattgccgaaatggagaaagagagctggatcgtggacaagcagtgggcgcaggatctgacactcccttggcaatctggatccggcggggtctggcgggaaatgcaccacctggtggagtttgaaccccctcatgctgccaccattaaggttcttgccctgggaaatcaggagggcagcctcaaaacggctctgacaggggccatgagagtgaccaaggacaccaacaattctaaactttacaagctgcacggcggacatgtcgcttgccgcgtgaaactcagcgccctgacactgaagggcacctcctataagatgtgtacagataaaatgtctttcgttaagaaccccacggacaccgggcacggaacagcggtgatgcaggtcaaagtgccgaagggcgccccttgccggatccccgtgatggttgctgatgacctcaccgccgctgtcaataaagggattctggtgacagtgaaccctatcgccagcaccaatgacgatgaagtccttatcgaggtgaaccctccctttggagactcctacattatcgttggcacgggggatagcagactgacctatcagtggcacaaggagggatcttccattggcaaactcttcacacaaaccatgaagggcgcggaacgcctggccgtgatgggggacgctgcctgggatttcggaagcgctggcgggtttttcacatctgtcggaaagggcatccataccgtgtttgggtccgccttccagggcctgtttggaggccttagctggattacgaaagttatcatgggggtggtcctcatctgggtgggaattaatacacggaacatgaccatgtccatgtctatgatcctggttggcgtgattatgatgttcctgagcctcggggtcggagccgaccagggctgtgctatcaatttttccaag

SEQ ID NO: 829 - RNA, 2091 nt, synthetic construct
  misc_feature 1..2091: note = derived and/or modified CDS sequence (opt5) from YFV__JF912180__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggcgcaacagatggcttctgctcaatgtcacgagcgaggatctggggaaaaccttttccgtgggaacaggcaactgcaccacaaatattctggaagccaagtactggtgtcccgactctatggagtataactgccccaatctcagcccgcgggaggaacccgatgacatcgattgttggtgctacggggttgaaaacgtgcgcgtcgcttatggaaaatgtgactccgccggcagatctcggcgcagcagacgggcgattgatctgcctacccacgagaatcatggccttaagacacgccaggagaaatggatgaccgggagaatgggagaacggcagctgcagaagatcgagcgctggctcgtgagaaaccccttctttgctgccacggccctggctattgcctaccttgttggctccaatatgacccaacgggtggtcatcgctctgctcgtgctggccgtggggcctgcgtatagcgcccactgcatcggaattacagacagagatttcatcgaaggcgtccatgggggaacctgggtttctgctacactggagcaggacaagtgtgtgaccgtgatggcccccgataaaccttccctcgacattagcctggagacggtcgctatcgatggcccggccgaagcgcgcaaggtgtgctactctgccgttcttacaaacgtgaaaattaatgacaagtgtccctccaccggcgaggctcacctggaagaggaaaacgagggggacaatgcctgcaaacggacatatagcgatagaggatggggcaacgggtgtggactctttggcaaggggtctatcgtcgcttgcgccaagtttacctgcgccaaatccatgagcctgttcgaggtggaccagaccaagattcagtacgttatccgcgctcaacttcatgtgggagcgaaacaggaaaattggaacacagatatcaagacgctgaaattcgacgccctctccggctctcaggaggctgaatttaccggctacgggaaggccacactggagtgtcaggtccaaaccgccgtggatttcagcaactcctatattgctgaaatggagaaagagagctggatcgtcgacaagcagtgggcccaggatctgacactcccttggcaatctggatccggcggggtgtggcgggaaatgcaccacctggttgagtttgaaccccctcatgcggctaccattaaggtgcttgccctgggaaatcaggagggcagcctcaaaacggccctgacaggggctatgagagtcaccaaggacaccaacaattctaaactttacaagctgcacggcggacatgtgagctgccgcgttaaactctccgccctgacactgaagggcacctcttataagatgtgtacagataaaatgagcttcgtgaagaaccccacggacaccgggcacggaacagctgtcatgcaagtgaaagtgccgaagggcgccccttgccggatccccgttatggtcgcggatgacctcaccgccgctgtgaataaagggattctggtgacagtcaaccctatcgcctccaccaatgacgatgaagtgcttatcgaggttaaccctccctttggagacagctacattatcgtgggcacgggggattctagactgacctatcagtggcacaaggagggctccagcattggaaaactcttcacacagaccatgaagggcgctgaacgcctggccgtcatgggggacgcggcctgggatttcggatctgctggcgggtttttcacatccgtgggaaagggcatccataccgtttttgggagcgccttccagggcctgtttggaggcctttcctggattacgaaagtgatcatgggggtcgtgctcatctgggttggaattaatacacggaacatgaccatgtctatgagcatgatcctggtgggcgtcattatgatgttcctgtccctcggggtgggagctgaccagggctgtgccatcaattttgggaag

SEQ ID NO: 830 - RNA, 2091 nt, synthetic construct
  misc_feature 1..2091: note = derived and/or modified CDS sequence (opt5) from YFV__JF912181__X-SS-prME-XX
  source 1..2091: mol_type = other RNA
atgagaggcctgagctcccggaagcgcagatctcacgaggtgctcaccgtccatttcctgatccttgggatgatgctgatgacaggaggcgttacgctcgtgcggaaaagccgctggctgcttctgaacgtgacctccgaagacctcgggaagacattttctgtcggaaccggcaattgcacaaccaacattctggatgccaaaaattggtgtcccgacagcatggagtacaactgccccaatctgtccccgagagaggaacccgatgacatcgattgttggtgctatggggtggaaaacgttcgggtggcttacggaaagtgtgactctgccggccgcagcagacggtcccgcagagcgattgatctccctacacacgagaatcatggcctgaaaacccggcaggagaagtggatgacggggcgcatgggagaaagacaacttcagaagatcgagcggtggctggtccgcaaccccttctttgctgtgaccgccctcgccattgcttatctggttggcagcaatatgacacagagagtggtcatcgcccttctggtgctcgctgtggggcctgcctactctgcgcactgcatcggaattaccgaccgggatttcatcgaaggcgtccatgggggaacatgggtttccgccaccctggagcaggacaaatgtgtgacggtgatggctcccgataagcctagcctggacatttctctcgagacagtcgccatcgatggcccggctgaagccagaaaagtgtgctattccgcggttctgacccacgtgaagattaacgacaaatgtcccagcacaggcgaggcccaccttgctgaagagaatgaaggggacaacgcctgcaagcgcacctactctgatcggggatggggcaatgggtgtggactgtttggcaaggggtccatcgtcgcttgcgccaaatttacctgcgccaagagcatgtccctcttcgaggtggaccaaacaaaaattcagtatgttatcagagctcagctgcatgtgggagcgaagcaggagaactggaatgccgatatcaaaacgcttaagttcgacgctctgtctggcagccaagaagccgagtttaccggctacgggaaagccacactcgaatgtcaggtccagaccgctgtggatttctccaacagctacattgccgagatggaaaaggagtcttggatcgtcgaccgccagtgggcgcaagatctgacactgccttggcagtccggaagcggcggggtgtggcgggagatgcaccatctcgttgaatttgagccccctcacgctgccaccattaaggtgctggcccttggaaaccaggaaggctctctgaaaacggctctcacaggggccatgagagtcaccaaggacgctaatggcagcaacctgtataaacttcacggaggccatgtgtcctgccgcgttaagctgtctgccctcaccctgaaagggacaagctacaagatgtgtaccgataagatgtccttcgtgaaaaatcccacagacacgggacacggcaccgcggtcatgcaagtgaaggtgccgaaaggggccccttgccggatccccgttatggtcgctgatgacctgacagccgctgtgaacaagggcattctcgtgaccgtcaatcctatcgccagcacaaacgaggacgaagtgctgatcgaggttaatcctccctttggagattcttatattatcgtggggaccggcgactccagacttacgtaccagtggcataaagagggaagctctattggcaagctgttcacccagacaatgaagggggcggaacgcctcgccgtcatgggagatgctgcctgggacttctccagcgctggcgggtttttcacctccgtgggaaaaggcatccacatggtttttgggtctgccttccagggcctgtttggaggcctgagctggattacaaaggtgatcatcggggccgtccttatttgggtgggaatcaacatgcggaatatgaccatgtccatgggcatgattctcgttggggtgatcatgatgttcctgtctctgggagtcggcgctgatcaagggtgtgcgattaactttggcaaa

SEQ ID NO: 831 - RNA, 2091 nt, synthetic construct
  misc_feature 1..2091: note = derived and/or modified CDS sequence (opt5) from YFV__JF912182__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggaaaaaccgctggcttctgctcaatgtcacgagcgaggatctggggaagaccttttccgtgggaacaggcaactgcaccacaaatattctggaagccaaatactggtgtcccgactctatggagtataactgccccaatctcagcccgagagaggaacccgatgacatcgattgttggtgctacggggttgaaaacgtgcgggtcgcttatggaaagtgtgactccgccggccgctctagacggagccgcagagcgattgatctgcctacccacgagaatcatggccttaaaacacggcaggagaagtggatgaccgggcgcatgggagaaagacagctgcagaagatcgagcggtggctcgtgcgcaaccccttctttgctgccacggccctggctattgcctaccttgttggctccaatatgacccaaagagtggtcatcgctctgctcgtgctggccgtggggcctgcgtatagcgcccactgcatcggaattacagaccgggatttcatcgaaggcgtccatgggggaacctgggtttctgctacactggagcaggacaaatgtgtgaccgtgatggcccccgataagccttccctcgacattagcctggagacggtcgctatcgatggcccggccgaagcgagaaaagtgtgctactctgccgttcttacaaacgtgaagattaatgacaaatgtccctccaccggcgaggctcacctggaagaggaaaacgagggggacaatgcctgcaagcgcacatatagcgatcggggatggggcaacgggtgtggactctttggcaaggggtctatcgtcgcttgcgccaaattcgcctgcgctaagtccatgagcctgtttgaggtggaccagaccaaaattcagtacgttatcagagcgcaacttcatgtgggagccaagcaggaaaattggaacaccgatatcaaaacactgaagttcgacgctctctccggctctcaggaggccgaatttacgggctacgggcgcgccaccctggagtgtcaggtccaaacagctgtggatttcagcaactcctatattgccgaaatggagaaagagagctggatcgtcgacaagcagtgggcgcaggatctgaccctcccttggcaatctggatccggcggggtgtggcgggaaatgcaccacctggttgagtttgaaccccctcatgctgccacaattaaggtgcttgccctgggaaatcaggagggcagcctcaaaaccgctctgacgggggccatgagagtcacaaaggacaccaacaattctaaactttacaagctgcacggcggacatgtggcttgccgcgttaaactcagcgccctgaccctgaagggcacatcctataagatgtgtaccgataaaatgtctttcgtgaagaaccccacagacacggggcacggaaccgcggtcatgcaagtgaaagtgccgaagggcgccccttgccggatccccgttatggtcgctgatgacctcacagccgctgtgaataaagggattctggtgaccgtcaaccctatcgccagcacaaatgacgatgaagtgcttatcgaggttaaccctccctttggagactcctacattatcgtgggcaccggggatagcagactgacgtatcagtggcacaaggagggatcttccattggcaaactcttcacccagacaatgaagggcgcggaacgcctggccgtcatgggggacgctgcctgggatttcggaagcgctggcgggtttttcacctctgtgggaaagggcatccatacagtttttgggtccgccttccagggcctgtttggaggccttagctggattaccaaagtgatcatgggggtcgtgctcatctgggttggaattaatacgcggaacatgacaatgtccatgtctatgatcctggtgggcgtcattatgatgttcctgagcctcggggtgggagccgaccagggctgtgctatcaattttgggaag

SEQ ID NO: 832 - RNA, 2091 nt, synthetic construct
  misc_feature 1..2091: note = derived and/or modified CDS sequence (opt5) from YFV__JF912183__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggcgcaacagatggcttctgctcaatgtcacgagcgaggatctggggaaaaccttttccgtgggaacaggcaactgcaccacaaatattctggaagccaagtactggtgtcccgactctatggagtataactgccccaatctcagcccgcgggaggaacccgatgacatcgattgttggtgctacggggttgaaaacgtgcgcgtcgcttatggaaaatgtgactccgccggcagatctcggcgcagcagacgggcgattgatctgcctacccacgagaatcatggccttaagacacgccaggagaaatggatgaccgggagaatgggagaacggcagctgcagaagatcgagcgctggctcgtgagaaaccccttctttgctgccacggccctggctattgcctaccttgttggctccaatatgacccaacgggtggtcatcgctctgctcgtgctggccgtggggcctgcgtatagcgcccactgcatcggaattacagacagagatttcatcgaaggcgtccatgggggaacctgggtttctgctacactggagcaggacaagtgtgtgaccgtgatggcccccgataaaccttccctcgacattagcctggagacggtcgctatcgatggcccggccgaagcgcgcaaggtgtgctactctgccgttcttacaaacgtgaaaattaatgacaagtgtccctccaccggcgaggctcacctggaagaggaaaacgagggggacaatgcctgcaaacggacatatagcgatagaggatggggcaacgggtgtggactctttggcaaggggtctatcgtcgcttgcgccaagtttacctgcgccaaatccatgagcctgttcgaggtggaccagaccaagattcagtacgttatccgcgctcaacttcatgtgggagcgaaacaggaaaattggaacacagatatcaagacgctgaaattcgacgccctctccggctctcaggaggctgaatttaccggctacgggaaggccacactggagtgtcaggtccaaaccgccgtggatttcagcaactcctatattgctgaaatggagaaagagagctggatcgtcgacaagcagtgggcccaggatctgacactcccttggcaatctggatccggcggggtgtggcgggaaatgcaccacctggttgagtttgaaccccctcatgcggctaccattaaggtgcttgccctgggaaatcaggagggcagcctcaaaacggccctgacaggggctatgagagtcaccaaggacaccaacaattctaaactttacaagctgcacggcggacatgtggcctgccgcgttaaactcagcgctctgacactgaagggcacctcctataagatgtgtacagataaaatgtctttcgtgaagaaccccacggacaccgggcacggaacagccgtcatgcaagtgaaagtgccgaagggcgcgccttgccggatccccgttatggtcgccgatgacctcaccgctgccgtgaataaagggattctggtgacagtcaaccctatcgctagcaccaatgacgatgaagtgcttatcgaggttaaccctccctttggagactcctacattatcgtgggcacgggggatagcagactgacctatcagtggcacaaggagggatcttccattggcaaactcttcacacagaccatgaagggcgccgaacgcctggcggtcatgggggacgccgcttgggatttcggaagcgccggcgggtttttcacatctgtgggaaagggcatccataccgtttttgggtccgctttccagggcctgtttggaggccttagctggattacgaaagtgatcatgggggtcgtgctcatctgggttggaattaatacacggaacatgaccatgtccatgtctatgatcctggtgggcgtcattatgatgttcctgagcctcggggtgggagccgaccagggctgtgccatcaattttgggaag

SEQ ID NO: 833 - RNA, 2091 nt, synthetic construct
  misc_feature 1..2091: note = derived and/or modified CDS sequence (opt5) from YFV__JF912184__X-SS-prME-XX
  source 1..2091: mol_type = other RNA
atgagaggcctgagctcccggaagcgcagatctcaggacgccctcaccgtgcaattcctgatccttgggatgctgctcatggtcggaggcgttacactggtgcggcgcaacagatggcttctgctcaatgtgacgagcgaggatctggggaaaaccttttccgtcggaacaggcaactgcaccacaaatattctggaagctaagtactggtgtcccgactctatggagtataactgccccaatctcagcccgcgggaggaacccgatgacatcgattgttggtgctacggggtggaaaacgttcgcgtggcctatggaaaatgtgactccgcgggcagatctcggcgcagcagacgggctattgatctgcctacccacgagaatcatggccttaagacacgccaggagaaatggatgaccgggagaatgggagaacggcagctgcagaagatcgagcgctggctcgtcagaaaccccttctttgccgccacggctctggccattgcttaccttgtgggctccaatatgacccaacgggttgtgatcgccctgctcgtcctggcggtggggcctgcctatagcgctcactgcatcggaattacagacagagatttcatcgaaggcgtgcatgggggaacctgggtctctgccacactggagcaggacaagtgtgttaccgtgatggctcccgataaaccttccctcgacattagcctggagacggtggccatcgatggcccggcggaagcccgcaaggtctgctactctgctgtgcttacaaacgttaaaattaatgacaagtgtccctccaccggcgaggcccacctggaagaggaaaacgagggggacaatgcttgcaaacggacatatagcgatagaggatggggcaacgggtgtggactctttggcaaggggtctatcgtggcctgcgccaagtttacctgcgctaaatccatgagcctgttcgaggtcgaccagaccaagattcagtacgtgatccgcgcgcaacttcatgttggagccaaacaggaaaattggaacacagatatcaagacgctgaaattcgacgctctctccggctctcaggaggccgaatttaccggctacgggaaggccacactggagtgtcaggtgcaaaccgctgtcgatttcagcaactcctatattgccgaacgggagaaagagagctggatcgtggacaagcagtgggcgcaggatctgacactcccttggcaatctggatccggcggggtctggagagaaatgcaccacctggtggagtttgaaccccctcatgctgccaccattaaggttcttgccctgggaaatcaggagggcagcctcaaaacggctctgacaggggccatgcgcgtgaccaaggacaccaacaattctaaactttacaagctgcacggcggacatgtcgcttgccgggtgaaactcagcgccctgacactgaagggcacctcctataagatgtgtacagataaaatgtctttcgttaagaaccccacggacaccgggcacggaacagcggtgatgcaggtcaaagtgccgaagggcgccccttgcagaatccccgtgatggttgctgatgacctcaccgccgctgtcaataaagggattctggtgacagtgaaccctatcgccagcaccaatgacgatgaagtccttatcgaggtgaaccctccctttggagactcctacattatcgttggcacgggggatagccgcctgacctatcagtggcacaaggagggatcttccattggcaaactcttcacacaaaccatgaagggcgcggaacggctggccgtgatgggggacgctgcctgggatttcggaagcgctggcgggtttttcacatctgtcggaaagggcatccataccgtgtttgggtccgccttccagggcctgtttggaggccttagctggattacgaaagttatcatgggggtggtcctcatctgggtgggaattaatacaagaaacatgaccatgtccatgtctatgatcctggttggcgtgattatgatgttcctgagcctcggggtcggagccgaccagggctgtgctatcaattttgggaag

SEQ ID NO: 834 - RNA, 2091 nt, synthetic construct
  misc_feature 1..2091: note = derived and/or modified CDS sequence (opt5) from YFV__JF912185__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggaaaaaccgctggcttctgctcaatgtcacgagcgaggatctggggaagaccttttccgtgggaacaggcaactgcaccacaaatattctggaagccaaatactggtgtcccgactctatggagtataactgccccaatctcagcccgagagaggaacccgatgacatcgattgttggtgctacggggttgaaaacgtgcgggtcgcttatggaaagtgtgactccgccggccgctctagacggagccgcagagcgattgatctgcctacccacgagaatcatggccttaaaacacggcaggagaagtggatgaccgggcgcatgggagaaagacagctgcagaagatcgagcggtggctcgtgcgcaaccccttctttgctgccacggccctggctattgcctaccttgttggctccaatatgacccaaagagtggtcatcgctctgctcgtgctggccgtggggcctgcgtatagcgcccactgcatcggaattacagaccgggatttcatcgaaggcgtccatgggggaacctgggtttctgctacactggagcaggacaaatgtgtgaccgtgatggcccccgataagccttccctcgacattagcctggagacggtcgctatcgatggcccggccgaagcgagaaaagtgtgctactctgccgttcttacaaacgtgaagattaatgacaaatgtccctccaccggcgaggctcacctggaagaggaaaacgagggggacaatgcctgcaagcgcacatatagcgatcggggatggggcaacgggtgtggactctttggcaaggggtctatcgtcgcttgcgccaaatttacctgcgccaagtccatgagcctgttcgaggtggaccagaccaaaattcagtacgttatcagagctcaacttcatgtgggagcgaagcaggaaaattggaacacagatatcaaaacgctgaagttcgacgccctctccggctctcaggaggctgaatttaccggctacgggcgcgccacactggagtgtcaggtccaaaccgccgtggatttcagcaactcctatattgctgaaatggagaaagagagctggatcgtcgacaagcagtgggcccaggatctgacactcccttggcaatctggatccggcggggtgtggcgggaaatgcaccacctggttgagtttgaaccccctcatgcggctaccattaaggtgcttgccctgggaaatcaggagggcagcctcaaaacggccctgacaggggctatgagagtcaccaaggacaccaacaattctaaactttacaagctgcacggcggacatgtggcctgccgcgttaaactcagcgctctgacactgaagggcacctcctataagatgtgtacagataaaatgtctttcgtgaagaaccccacggacaccgggcacggaacagccgtcatgcaagtgaaagtgccgaagggcgcgccttgccggatccccgttatggtcgccgatgacctcaccgctgccgtgaataaagggattctggtgacagtcaaccctatcgctagcaccaatgacgatgaagtgcttatcgaggttaaccctccctttggagactcctacattatcgtgggcacgggggatagcagactgacctatcagtggcacaaggagggatcttccattggcaaactcttcacacagaccatgaagggcgccgaacgcctggcggtcatgggggacgccgcttgggatttcggaagcgccggcgggtttttcacatctgtgggaaagggcatccataccgtttttgggtccgctttccagggcctgtttggaggccttagctggattacgaaagtgatcatgggggtcgtgctcatctgggttggaattaatacacggaacatgaccatgtccatgtctatgatcctggtgggcgtcattatgatgttcctgagcctcggggtgggagccgaccagggctgtgccatcaattttgggaag

SEQ ID NO: 835 - RNA, 2091 nt, synthetic construct
  misc_feature 1..2091: note = derived and/or modified CDS sequence (opt5) from YFV__JF912186__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggcgcagcagatggcttctgctcaacgtcacgtccgaggatctggggaaaaccttttctgtgggaacaggcaattgcaccacaaacattctggaagccaagtactggtgtcccgacagcatggagtataattgccccaacctctccccgcgggaggaacccgatgacatcgattgttggtgctacggggttgaaaatgtgcgcgtcgcttatggaaaatgtgactctgccggcagaagccggcgctccagacgggcgattgatctgcctacccacgagaaccatggccttaagacacgccaggagaaatggatgaccgggagaatgggagaacggcagctgcagaagatcgagcgctggctcgtgagaaatcccttctttgctgccacggccctggctattgcctaccttgttggcagcaacatgacccaacgggtggtcatcgctctgctcgtgctggccgtggggcctgcgtattctgcccactgcatcggaattacagacagagatttcatcgaaggcgtccatgggggaacctgggtttccgctacactggagcaggacaagtgtgtgaccgtgatggcccccgataaacctagcctcgacatttctctggagacggtcgctatcgatggcccggccgaagcgcgcaaggtgtgctactccgccgttcttacaaatgtgaaaattaacgacaagtgtcccagcaccggcgaggctcacctggaagaggaaaatgagggggacaacgcctgcaaacggacatattctgatagaggatggggcaatgggtgtggactctttggcaaggggtccatcgtcgcttgcgccaagtttacctgcgccaaaagcatgtccctgttcgaggtggaccagaccaagattcagtacgttatccgcgctcaacttcatgtgggagcgaaacaggaaaactggaatacagatatcaagacgctgaaattcgacgccctctctggcagccaggaggctgaatttaccggctacgggaaggccacactggagtgtcaggtccaaaccgccgtggatttctccaacagctatattgctgaaatggagaaagagtcttggatcgtcgacaagcagtgggcccaggatctgacactcccttggcaatccggaagcggcggggtgtggcgggaaatgcaccacctggttgagtttgaaccccctcatgcggctaccattaaggtgcttgccctgggaaaccaggagggctctctcaaaacggccctgacaggggctatgagagtcaccaaggacaccaataacagcaaactttacaagctgcacggcggacatgtggcctgccgcgttaaactctccgctctgacactgaagggcacctcttataagatgtgtacagataaaatgagcttcgtgaagaatcccacggacaccgggcacggaacagccgtcatgcaagtgaaagtgccgaagggcgcgccttgccggatccccgttatggtcgccgatgacctcaccgctgccgtgaacaaagggattctggtgacagtcaatcctatcgcttccaccaacgacgatgaagtgcttatcgaggttaatcctccctttggagacagctacattatcgtgggcacgggggattctagactgacctatcagtggcacaaggagggctccagcattggaaaactcttcacacagaccatgaagggcgccgaacgcctggcggtcatgggggacgccgcttgggatttcggatctgccggcgggtttttcacatccgtgggaaagggcatccataccgtttttgggagcgctttccagggcctgtttggaggcctttcctggattacgaaagtgatcatgggggtcgtgctcatctgggttggaattaacacacggaatatgaccatgtctatgagcatgatcctggtgggcgtcattatgatgttcctgtccctcggggtgggagccgaccagggctgtgccatcaactttgggaag

SEQ ID NO: 836 - RNA, 2091 nt, synthetic construct
  misc_feature 1..2091: note = derived and/or modified CDS sequence (opt5) from YFV__JF912187__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggcgcaacagatggcttctgctcaatgtcacgagcgaggatctggggaaaaccttttccgtgggaacaggcaactgcaccacaaatattctggaagccaagtactggtgttctgacagcatggagtataactgccccaatctctcccctcgggaggaaccggatgacatcgattgttggtgctacggggttgaaaacgtgcgcgtcgcttatggaaaatgtgactctgccggcagaagccggcgctccagacgggcgattgatctgcccacccacgagaatcatggccttaagacacgccaggagaaatggatgaccgggagaatgggagaacggcagctgcagaagatcgagcgctggctcgtgagaaaccctttctttgctgccacggccctggctattgcctaccttgttggcagcaatatgacccaacgggtggtcatcgctctgctcgtgctggccgtggggcccgcgtattctgcccactgcatcggaattacagacagagatttcatcgaaggcgtccatgggggaacctgggtttccgctacactggagcaggacaagtgtgtgaccgtgatggcccctgataaacccagcctcgacatttctctggagacggtcgctatcgatggccctgccgaagcgcgcaaggtgtgctactccgccgttcttacaaacgtgaaaattaatgacaagtgtccgagcaccggcgaggctcacctggaagaggaaaacgagggggacaatgcctgcaaacggacatattctgatagaggatggggcaacgggtgtggactctttggcaaggggtccatcgtcgcttgcgccaagtttacctgcgccaaaagcatgtccctgttcgaggtggaccagaccaagattcagtacgttatccgcgctcaacttcatgtgggagcgaaacaggaaaattggaacacagatatcaagacgctgaaattcgacgccctctctggcagccaggaggctgaatttaccggctacgggcgggccacactggagtgtcaggtccaaaccgccgtggatttctccaacagctatattgctgaaatggagaaggagtcttggatcgtcgacaaacagtgggcccaggatctgacactcccctggcaatccggaagcggcggggtgtggagagaaatgcaccacctggttgagtttgaacctccccatgcggctaccattaaggtgcttgccctgggaaatcaggagggctctctcaagacggccctgacaggggctatgcgcgtcaccaaagacaccaacaatagcaaactttacaagctgcacggcggacatgtggcctgccgggttaagctctccgctctgacactgaaaggcacctcttataagatgtgtacagataagatgagcttcgtgaaaaaccctacggacaccgggcacggaacagccgtcatgcaagtgaaggtgcccaaaggcgcgccgtgcagaatccctgttatggtcgccgatgacctcaccgctgccgtgaataaggggattctggtgacagtcaaccccatcgcttccaccaatgacgatgaagtgcttatcgaggttaaccctccctttggagacagctacattatcgtgggcacgggggattctcgcctgacctatcagtggcacaaagagggctccagcattggaaaactcttcacacagaccatgaagggcgccgaacggctggcggtcatgggggacgccgcttgggatttcggatctgccggcgggtttttcacatccgtgggaaagggcatccataccgtttttgggagcgctttccagggcctgtttggaggcctttcctggattacgaaggtgatcatgggggtcgtgctcatctgggttggaattaatacaagaaacatgaccatgtctatgagcatgatcctggtgggcgtcattatgatgttcctgtccctcggggtgggagccgaccagggctgtgccatcaattttgggaaa

SEQ ID NO: 837 - RNA, 2091 nt, synthetic construct
  misc_feature 1..2091: note = derived and/or modified CDS sequence (opt5) from YFV__JF912189__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggcgcaacagatggcttctgctcaatgtcacgagcgaggatctggggaaaaccttttccgtgggaacaggcaactgcaccacaaatattctggaagccaagtactggtgtcccgactctatggagtataactgccccaatctcagcccgcgggaggaacccgatgacatcgattgttggtgctacggggttgaaaacgtgcgcgtcgcttatggaaaatgtgactccgccggcagatctcggcgcagcagacgggcgattgatctgcctacccacgagaatcatggccttaagacacgccaggagaaatggatgaccgggagaatgggagaacggcagctgcagaagatcgagcgctggctcgtgagaaaccccttctttgctgccacggccctggctattgcctaccttgttggctccaatatgacccaacgggtggtcatcgctctgctcgtgctggccgtggggcctgcgtatagcgcccactgcatcggaattacagacagagatttcatcgaaggcgtccatgggggaacctgggtttctgctacactggagcaggacaagtgtgtgaccgtgatggcccccgataaaccttccctcgacattagcctggagacggtcgctatcgatggcccggccgaagcgcgcaaggtgtgctactctgccgttcttacaaacgtgaaaattaatgacaagtgtccctccaccggcgaggctcacctggaagaggaaaacgagggggacaatgcctgcaaacggacatatagcgatagaggatggggcaacgggtgtggactctttggcaaggggtctatcgtcgcttgcgccaagtttacctgcgccaaatccatgagcctgttcgaggtggaccagaccaagattcagtacgttatccgcgctcaacttcatgtgggagtcaaacaggaaaattggaacacagatatcaagacgctgaaattcgacgcgctctccggctctcaggaggccgaatttaccggctacgggcgggctacactggagtgtcaggtgcaaaccgccgtcgatttcagcaactcctatattgccgaaatggagaaggagagctggatcgtggacaaacagtgggctcaggatctgacactcccttggcaatctggatccggcggggtttggagagaaatgcaccacctggtggagtttgaaccccctcatgccgcgaccattaaggtccttgctctgggaaatcaggagggcagcctcaagacggccctgacaggggccatgcgcgtgaccaaagacaccaacaattctaaactttacaagctgcacggcggacatgttgcttgccgggtgaagctcagcgccctgacactgaaaggcacctcctataagatgtgtacagataagatgtctttcgtcaaaaaccccacggacaccgggcacggaacagctgtgatgcaagtgaaggttccgaaaggcgccccttgcagaatccccgtcatggtggcggatgacctcaccgccgctgtgaataaggggattctggtcacagtgaaccctatcgccagcaccaatgacgatgaagttcttatcgaggtgaaccctccctttggagactcctacattatcgtcggcacgggggatagccgcctgacctatcagtggcacaaagagggatcttccattggcaaactcttcacacagaccatgaagggcgctgaacggctggccgtgatgggggacgcggcctgggatttcggaagcgctggcgggtttttcacatctgttggaaagggcatccataccgtgtttgggtccgccttccagggcctgtttggaggccttagctggattacgaaggtcatcatgggggtggttctcatctgggtgggaattaatacaagaaacatgaccatgtccatgtctatgatcctggtcggcgtgattatgatgttcctgagcctcggggtgggagctgaccagggctgtgccatcaattttgggaaa

SEQ ID NO: 838 - RNA, 2061 nt, synthetic construct
  misc_feature 1..2061: note = derived and/or modified CDS sequence (opt5) from YFV__AH005112__X-SS-prME-XX
  source 1..2061: mol_type = other RNA
atgagaggcctgagctcccggaagcgcagatctcacgacgtgctcaccgtccagttcctgatccttgggatgctgctcatggccggaggcgttacactggtgcggaaaaaccgctggcttctgctcaatgtgacgagcgaggatctggggaagaccttttccgtcggaacaggcaactgcaccacaaatattctggaagctaaatactggtgtcccgactctatggagtataactgccccaatctcagcccgagagaggaacccgatgacatcgattgttggtgctacggggtggaaaacgttcgggtggcctatggaaagtgtgactccgcgggccgctctagacggagccgcagagctattgatctgcctacccatgagaatcacggccttaaaacacggcaagagaagtggatgaccgggcgcatgggagaaagacagctgcagaagatcgagcggtggctcgtccgcaaccccttctttgccgtgacggccctgaccattgcttaccttgttggctccaatatgacacagagagtggtcatcgccctgctcgtgctggctgtggggcctgcctatagcgcgcattgcatcggaattaccgaccgggatttcatcgaaggcgtccacgggggaacatgggtttctgccaccctggagcaagacaaatgtgtgacggtgatggctcccgataagccttccctcgacattagcctggagacagtcgccatcgatggcccggctgaagccagaaaagtgtgctacaacgcggttcttacccatgtgaagattaatgacaaatgtccctctacaggcgaggcccacctggctgaagagaacgaaggggacaatgcctgcaagcgcacctattccgatcggggatggggcaacgggtgtggactctttggcaaggggagcatcgtcgcttgcgccaaatttacctgcgccaagacaatgtctctgttcgaggtggaccagacgaaaattcagtacgttatcagagctcagcttcacgtgggagcgaagcaagagaattggaacaccgatatcaaaacactgaagttcgacgccctctccggcagccaggaagctgagtttaccggctacgggaaagccacactggaatgtcaggtccagaccgccgtggatttcggaaactcctatattgctgagatggaaaaggagtcttggatcgtcgaccgccaatgggcccaggatctgacgctcccttggcagagcggctccgggggagtgtggcgggagatgcatcacctggttgaatttgagccccctcatgcggctacaattagagtgcttgccctgggcaatcaagaagggagcctcaagaccgccctgaccggcgctatgcgcgtcacaaaagacaccaacgataataacctttacaagctgcacggaggccacgtgtcttgccgggttaaactctccgccctgacactgaaggggacgagctataaaatgtgtaccgacaagatgtctttcgtgaagaatcccacagataccggacatggcacagtcgtgatgcaagtgaaagttccgaagggggctccttgcaaaatccccgtcattgtggccgacgacctcaccgcggccatcaacaagggaatcctggtgacggtcaatcctattgctagcaccaacgatgacgaggtgcttatcgaagttaatcctccctttggcgattcctacattatcgtggggacaggcgactctagactgacctatcagtggcacaaagagggaagctccattggcaaactcttcacacagaccatgcgcgggcaggagcggctggccgtcatgggagatacggcttgggacttcagctctgccggcgggtttttcacatccatcggaaagggcatccataccgtgtttgggagcgcgttccagggcctgtttggaggcctttcttggattacaaaggttatcatgggggccgtgctcatttgggtcggaatcaacaccagaaatatgaccatgtccatgagcatgattctggtgggcgttatcatgatgttcctgtccctcggggtgggagct

SEQ ID NO: 839 - RNA, 2091 nt, synthetic construct
  misc_feature 1..2091: note = derived and/or modified CDS sequence (opt5) from YFV__FJ654700__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaacaccgatatcaaaacacttaagtttgacgctctgagcggatcccaggaagtggagttcaccggctacggcaaagcgacactcgaatgtcaggtccagaccgccgtggattttgggaactcttatattgctgagatggaaacggagagctggatcgttgaccggcaatgggcccaggatctgacactgccttggcagtccggaagcggcggggtgtggagagagatgcatcacctcgtcgagttcgagccccctcatgccgtgaccattcgcgttctggctcttggaaatcaagaaggctctctgaagaccgccctcacaggggcgatgcgggtgaccaaggacacaaacgataataacctgtacaaacttcacggcggacacgtctcctgcagagtgaagctgagcgctctcacgctgaaaggcacctcttataagatctgtacagacaaaatgtttttcgtgaagaatcccaccgatacagggcatggaaccgttgtcatgcaagtgaaggtgagcaaaggcgccccgtgccgcattcctgtcatcgtggccgacgacctgacggctgccatcaacaaggggattctcgttaccgtgaatcccatcgcttccacaaacgatgacgaggtcctgattgaagtgaatcctcccttcggagattcttacatcattgttggcagaggggacagccggcttacctatcagtggcacaaagagggctccagcatcggaaagctgtttacacagaccatgaaaggcgtggagcgcctcgccgtcatgggggatacggcgtgggacttctcttccgccggaggctttttcacaagcgtggggaagggaatccataccgtttttggctctgctttccaggggctgtttggcggactgaactggattacaaaggtgatcatgggcgccgtccttatttgggtggggatcaatacccggaacatgaccatgtccatgagcatgattctcgtgggagtcatcatgatgttcctgtccctgggcgttggggctgatcagggatgtgccattaattttggcaaa

SEQ ID NO: 840 - RNA, 2091 nt, synthetic construct
  misc_feature 1..2091: note = derived and/or modified CDS sequence (opt5) from YFV__KM388817__X-SS-prME-XX
  source 1..2091: mol_type = other RNA
atgagaggcctgagctcccggaagcgcagatctcaggacgtgctcaccgtccaattcctgatccttgggatgctgctcatggccggaggcgttacactggtgcggcgcaacagatggcttctgctcaatgtgacgagcgaggatctggggaaaaccttttccgtcggaacaggcaactgcaccacaaatattctggaagctaagtactggtgtcccgactctatggagtataactgccccaatctcagcccgcgggaggaacccgatgacatcgattgttggtgctacggggtggaaaacgttcgcgtggcctatggaaaatgtgactccgcgggcagatctcggcgcagcagacgggctattgatctgcctacccacgagaatcatggccttaagacacgccaggagaaatggatgaccgggagaatgggagaacggcagctgcagaagatcgagcgctggctcgtcagaaaccccttctttgccgccacggctctgaccattgcctaccttgtgggctccaatatgacacaacgggttgtgatcgctctgctcgtcctggccgtggggcctgcgtatagcgcccactgcatcggaattaccgacagagatttcatcgaaggcgtgcatgggggaacatgggtctctgctaccctggagcaggacaagtgtgttacggtgatggcccccgataaaccttccctcgacattagcctggagacagtggctatcgatggcccggccgaagcgcgcaaggtctgctactctgccgtgcttaccaacgttaaaattaatgacaagtgtccctccacaggcgaggctcacctggaagaggaaaacgagggggacaatgcctgcaaacggacctatagcgatagaggatggggcaacgggtgtggactctttggcaaggggtctatcgtggcttgcgccaagtttacctgcgccaaatccatgagcctgttcgaggtcgaccagacaaagattcagtacgtgatccgcgctcaacttcatgttggagcgaaacaggaaaattggaacacggatatcaagaccctgaaattcgacgccctctccggctctcaggaggctgaatttacaggctacgggcgggccaccctggagtgtcaggtgcaaacagccgtcgatttcagcaactcctatattgctgaaatggagaaggagagctggatcgtggacaaacagtgggcccaggatctgaccctcccttggcaatctggatccggcggggtctggagagaaatgcaccacctggtggagtttgaaccccctcatgcggctacgattaaggttcttgccctgggaaatcaggagggcagcctcaagacagccctgaccggggctatgcgcgtgaccaaagacacaaacaattctaaactttacaagctgcacggcggacatgtcgcctgccgggtgaagctcagcgctctgaccctgaaaggcacatcctataagatgtgtacggataagatgtctttcgttaaaaaccccaccgacacagggcacggaaccgccgtgatgcaggtcaaggtgccgaaaggcgcgccttgcagaatccccgtgatggttgccgatgacctcacagctgccgtcaataaggggattctggtgaccgtgaaccctatcgctagcacgaatgacgatgaagtccttatcgaggtgaaccctccctttggagactcctacattatcgttggcaccggggatagccgcctgacatatcagtggcacaaagagggatcttccattggcaaactcttcacccaaacaatgaagggcgccgaacggctggcggtgatgggggacgccgcttgggatttcggaagcgccggcgggtttttcacctctgtcggaaagggcatccatacggtgtttgggtccgctttccagggcctgtttggaggccttagctggattacaaaggttatcatgggggtggtcctcatctgggtgggaattaataccagaaacatgacaatgtccatgtctatgatcctggttggcgtgattatgatgttcctgagcctcggggtcggagccgaccagggctgtgccatcaattttgggaaa

SEQ ID NO: 841 - RNA, 2091 nt, synthetic construct
  misc_feature 1..2091: note = derived and/or modified CDS sequence (opt5) from YFV__HM582851__X-SS-prME-XX
  source 1..2091: mol_type = other RNA
atgagaggcctgagctcccggaagcgcagatctcaggacgtgctcaccgtccaattcctgatccttgggatgctgctcatggttggaggcgtgacactggtgcggcgcaacagatggcttctgctcaatgtcacgagcgaggatctggggaaaaccttttccgtgggaacaggcaactgcaccacaaatattctggaagccaagtactggtgtcccgactctatggagtataactgccccaatctcagcccgcgggaggaacccgatgacatcgattgttggtgctacggggttgaaaacgtgcgcgtcgcttatggaaaatgtgactccgccggcagatctcggcgcagcagacgggcgattgatctgcctacccacgagaatcatggccttaagacacgccaggagaaatggatgaccgggagaatgggagaacggcagctgcagaagatcgagcgctggctcgtgagaaaccccttctttgctgccacggccctggctattgcctaccttgttggctccaatatgacccaacgggtggtcatcgctctgctcgtgctggccgtggggcctgcgtatagcgcccactgcatcggaattacagacagagatttcatcgaaggcgtccatgggggaacctgggtttctgctacactggagcaggacaagtgtgtgaccgtgatggcccccgataaaccttccctcgacattagcctggagacggtcgctatcgatggcccggccgaagcgcgcaaggtgtgctactctgccgttcttacaaacgtgaaaattaatgacaagtgtccctccaccggcgaggctcacctggaagaggaaaacgagggggacaatgcctgcaaacggacatatagcgatagaggatggggcaacgggtgtggactctttggcaaggggtctatcgtcgcttgcgccaagtttacctgcgccaaatccatgagcctgttcgaggtggaccagaccaagattcagtacgttatccgcgctcaacttcatgtgggagcgaaacaggaaaattggaacacagatatcaagacgctgaaattcgacgccctctccggctctcaggaggctgaatttaccggctacgggcgggccacactggagtgtcaggtccaaaccgccgtggatttcagcaactcctatattgctgaaatggagaaggagagctggatcgtcgacaaacagtgggcccaggatctgacactcccttggcaatctggatccggcggggtgtggagagaaatgcaccacctggttgagtttgaaccccctcatgcggctaccattaaggtgcttgccctgggaaatcaggagggcagcctcaagacggccctgacaggggctatgcgcgtcaccaaagacaccaacaattctaaactttacaagctgcacggcggacatgtggcctgccgggttaagctcagcgctctgacactgaaaggcacctcctataagatgtgtacagataagatgtctttcgtgaaaaaccccacggacaccgggcacggaacagccgtcatgcaagtgaaggtgccgaaaggcgcgccttgcagaatccccgttatggtcgccgatgacctcaccgctgccgtgaataaggggattctggtgacagtcaaccctatcgctagcaccaatgacgatgaagtgcttatcgaggttaaccctccctttggagactcctacattatcgtgggcacgggggatagccgcctgacctatcagtggcacaaagagggatcttccattggcaaactcttcacacagaccatgaagggcgccgaacggctggcggtcatgggggacgccgcttgggatttcggaagcgccggcgggtttttcacatctgtgggaaagggcatccataccgtttttgggtccgctttccagggcctgtttggaggccttagctggattacgaaggtgatcatgggggtcgtgctcatctgggttggaattaatacaagaaacatgaccatgtccatgtctatgatcctggtgggcgtcattatgatgttcctgagcctcggggtgggagccgaccagggctgtgccatcaattttgggaaa

SEQ ID NO: 842 - RNA, 2091 nt, synthetic construct
  misc_feature 1..2091: note = derived and/or modified CDS sequence (opt5) from YFV__JN620362__X-SS-prME-XX
  source 1..2091: mol_type = other RNA
atgagaggcctgagctcccggaagcgcagatctaacgagatgaccatgatgcccctcctgatccttagcatggtgattctggccgggggagtcacactcgttcggaaaaatcgctggctgcttctgaacgtgacggctgaagacctcggcaagaccttctccgtggggacaggaaattgcaccacaaacatcctggaggccaaatactggtgtcctgattctatggaatataattgcccgaacctgagccccagagaggaacctgacgatattgactgttggtgctacggcgtcgagaatgtgcgggttgcgtatgggcgctgtgatgctgtgggaagatccaagcggtctcgcagagccatcgacctccccacccacgagaaccatggcctgaaaacacggcaggaaaagtggatgaccggccgcatgggggagagacaacttcagaagattgaacggtggctggtccgcaatccctttttcgccatcacggctctcgccatcgcttacctggtgggaaacaatatgacccagagagttgtgattgcccttctggtcctcgcggtgggccccgcctatagcgctcactgcatcgggattacagatcgggactttatcgagggagtgcatggcgggacctgggtctccgccacactggagcaggataaatgtgttaccgtgatggctcctgacaagccgagcctggatatttctctccaaacggtggccatcgacggacccgcggaagccagaaaagtctgctactccgctgtgctgacacacgttaagattaacgataaatgtcctagcaccggcgaggcccatcttgctgaagagaatgacggcgacaacgcctgcaagcgcacatattctgatcgggggtggggaaatggctgtgggctgttcggaaagggctccatcgtggcctgcgctaaatttacctgcgccaagagcatgtctctcttcgaagtcgaccagaccaaaatccagtacgtgattagagcgcagctgcacgttggggctaagcaagagaactggaacacagatatcaaaacgcttaagtttgacgccctgtccggaagccaggaggccgagttcaccggctacggcaaagctacactcgaatgtcaggtgcagaccgccgtcgattttggaaattcctatattgcggaaatggagaaggactcttggatcgtggatcgccaatgggctcaggacctgacactgccctggcagagcggatccggcgggatttggcgggaaatgcaccatctcgtcgagttcgagcctccccacgccgccaccatcagagtgctggctcttggaaaccaagaaggcagcctgaagacggccctcacaggggctatgcgcgttaccaaagatgagaatgacaacaatctgtacaaacttcatggcggacacgtgtcttgccgggtcaagctgtccgccctcaccctgaagggcacaagctataaaatgtgtaccgataagatgtcttttgtgaagaacccgacagacacggggcacggaaccgttgtgatgcaggtcaaagtgcctaagggcgcgccctgcaaaatccctgtgattgttgccgacgatctgacagctgccgtcaataaggggatcctcgtgaccgtgaaccccattgctagcacaaatgacgatgaagtcctgatcgaggtgaaccctcctttcggagactcctacattatcgttggcaccggggattctagacttacgtatcagtggcataaagaaggcagctccatcggaaagctgtttacccagacaatgaagggcgccgagcgcctcgcggtgatgggggacgccgcttgggatttcagctctgccggaggcttctttacctccgtcgggaaagggattcacacagtgttcggcagcgcttttcaagggctgttcggcggactgtcttggatcaccaaggttattatgggcgccgtgcttatctgggtcgggattaatacgcggaacatgacaatgtccatgagcatgatcctcgtgggagttattatgatgtttctgtccctgggcgtgggggccgaccagggatgtgctgtcaatttcggcaaa

SEQ ID NO: 843 - RNA, 2091 nt, synthetic construct
  misc_feature 1..2091: note = derived and/or modified CDS sequence (opt5) from YFV__JN811142__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaccacagatatcaaaacccttcggtttgacgctctgagcggatcccaggaagtggagttcattggctacggcaaggcgacactcgaatgtcaggtccagaccgccgtggattttgggaactcttatatcgctgagatggaaacggagagctggattgttgacagacaatgggcccaggatctgacactgccttggcagtccggaagcggcggggtgtggcgcgagatgcatcacctcgtcgagttcgagccccctcatgccgctaccatccgggtgctggcccttggaaaccaagaaggctctctgaaaaccgcgctcacaggggctatgagagttaccaaggacacaaatgataacaatctgtacaaacttcacggcggacacgtgtcctgccgcgtcaagctgagcgccctcacgctgaagggcacctcttataaaatttgtacagacaagatgtttttcgtgaaaaaccccaccgatacagggcatggaaccgtggttatgcaggtcaaggtgagcaagggcgccccgtgccggatccctgtgatcgtcgctgacgacctgacggccgctattaataaagggatcctcgtgaccgttaaccccattgcctccacaaatgatgacgaggtgctgatcgaagtcaaccctcccttcggagattcttacattatcgtgggcagaggggacagccgccttacctatcagtggcacaaggagggctccagcatcggaaaactgtttacacagaccatgaagggcgttgagcggctcgcggtgatgggggatacggcctgggacttctcttccgctggaggctttttcacaagcgtcgggaaaggcattcataccgtgtttggatctgccttccaagggctgtttggcggactgaattggatcacaaaggttattatgggcgctgtgcttatctgggtcgggattaacaccagaaatatgaccatgtccatgagcatgatcctcgtgggagtgattatgatgttcctgtccctgggcgtcggggccgatcagggatgtgcgatcaactttggcaag

SEQ ID NO: 844 - RNA, 2091 nt, synthetic construct
  misc_feature 1..2091: note = derived and/or modified CDS sequence (opt5) from YFV__DQ100292__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccccaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagctcgcaaagtgtgctacaacgccgttctgacacatgtgaagattaatgacaaatgtccctctaccggcgaggcgcaccttgccgaagagaacgaaggcgacaatgcttgcaagcggacctattccgatagagggtggggaaacggctgtgggctgttcggaaagggcagcatcgtcgcctgcgctaaatttacatgcgccaagtctatgtccctcttcgaggtggaccagacgaaaattcagtacgttatccgcgcccagctgcacgtgggggctaagcaagagaattggaacaccgatatcaaaacacttaagtttgacgcgctgagcggatcccaggaagtcgagttcattggctacggcaaagccaccctcgaatgtcaggtgcagacagctgtcgattttgggaactcttatatcgccgagatggaaaccgagagctggattgtggaccggcaatgggcccaggatctgacgctgccttggcagtccggaagcggcggggtttggagagagatgcatcacctcgtggagttcgagccccctcatgctgccacaatccgcgtcctggcgcttggaaatcaagaaggctctctgaagaccgctctcaccggggccatgcgggtgacaaaggacaccaacgataataacctgtacaaacttcacggcggacacgtttcctgcagagtgaagctgagcgccctcacactgaaaggcacgtcttataagatttgtaccgacaaaatgtttttcgtcaagaatcccacagataccgggcatggaacagtggtgatgcaggttaaggtcccgaaaggcgctccttgccgcatccccgtgatcgtggccgacgacctgaccgctgccgtcaacaaggggattctcgtgacggttaatcctatcgcgagcaccaacgatgacgaggtgctgattgaagtcaatcctcccttcggagattcctacatcattgtgggcagaggggactctcggcttacatatcagtggcacaaagagggcagctccatcggaaagctgtttacccagacaatgaaaggcgttgagcgcctcgccgtgatgggggataccgcttgggacttcagctctgccggaggctttttcacgtccgtcgggaagggaatccatacagtgtttggcagcgctttccaagggctgtttggcggactgaactggattaccaaggttatcatgggcgccgtgcttatttgggtcgggatcaatacacggaacatgaccatgtctatgtccatgattctcgtgggagtgatcatgatgttcctgagcctgggcgtcggggcggatcagggatgtgccattaattttggcaaa

SEQ ID NO: 845 - RNA, 2091 nt, synthetic construct; identical to SEQ ID NO: 280
  misc_feature 1..2091: note = derived and/or modified CDS sequence (opt5) from YFV__DQ118157__X-SS-prME-XX
  source 1..2091: mol_type = other RNA

SEQ ID NO: 846 - RNA, 2091 nt, synthetic construct
  misc_feature 1..2091: note = derived and/or modified CDS sequence (opt5) from YFV__DQ235229__X-SS-prME-XX
  source 1..2091: mol_type = other RNA
atgatcggcctgagctccagaaagcggcgctctaacgagatggccatgatgcccctcctgattcttagcatggtgatcctggctgggggagtcaccctcgttcggaaaaatagatggctgcttctgaacgtgacagccgaagacctcggcaagacgttctccctggggaccggaaattgcacaaccaacattctggaggcgaaatactggtgtcctgattctatggaatataattgcccgaacctcagcccccgcgaggaacctgacgatatcgactgttggtgctacggcgtggagaatgtcagagtggcttatgggcggtgtgatgccgttggacgctccaagagatctcggcgcgccattgacctgcccacacacgagaaccatggccttaaaaccagacaggaaaagtggatggctggccggatgggggagcgccaactgcagaagatcgaaagatggctcgtgcggaatccctttttcgccatcacagctctggccattgcgtaccttgtcggaaacaatatgacccagcgcgtggttatcgccctgctcgtgctggctgtcggccccgcctatagcgctcactgcattgggatcacggatagagactttattgagggagtgcatggcgggacctgggtgtccgccacactggagcagggaaaatgtgtcaccgttatggcgcctgataagccgagcctcgacatctctctgcaaacagtggccattgatggccccgctgaagcccggaaagtgtgctactccgctgtccttacccacgtgaagatcaacgacaaatgtcctagcacgggcgaggcccatctggccgaagagaatgatggggacaacgcttgcaagagaacatattctgaccgcggatggggcaatgggtgtggactcttcggcaaggggtccatcgttgcgtgcgccaaatttacctgcgctaagagcatgtctctgttcgaagtggatcagacaaaaattcagtacgtcatccgggcccagcttcacgtgggagccaagcaagagaactggaacaccgacattaaaaccctgaagtttgatgctctctccggcagccaggaggccgagttcacaggctacgggaaagcgacgctggaatgtcaggttcagaccgctgtggactttggaaattcctatatcgccgaaatggagaaggattcttggattgtcgacagacaatgggcccaggatctgacactcccctggcagagcggctccgggggaatctggcgcgaaatgcaccatctggtggagttcgagcctccccacgctgccaccatccgggtccttgctctgggcaaccaagaagggagcctcaagacagccctgaccggcgcgatgagagtgacgaaagacgagaatgataacaatctttacaagctgcatggaggccacgtttcttgccgcgtgaaactctccgccctgacactgaaggggaccagctataaaatgtgtaccgacaagatgtcttttgtcaagaacccgacagataccggacacggcacagtggttatgcaagtgaaagtccctaagggggctccctgcaaaattcctgtgatcgtggccgacgacctcacggctgccgttaataagggcattctggtcaccgtgaaccccatcgcgagcacaaatgatgacgaagtgcttattgaggtcaaccctcctttcggagattcctacatcatcgtggggaccggcgactctcggctgacatatcagtggcataaagaaggaagctccattggcaagctctttacccagacgatgaagggggccgagagactggctgttatgggagatgccgcttgggacttcagctctgccggcgggttctttacctccgtgggaaaaggcatccacacagtcttcgggagcgcctttcagggcctgttcggaggcctttcttggattaccaaggtgatcatgggggctgttctcatttgggtgggaatcaatacacgcaacatgaccatgtccatgagcatgattctggtcggcgtgatcatgatgtttctgtccctcggggttggagcggatcagggctgtgccgtgaatttcgggaaa

SEQ ID NO: 847 - RNA, 2088 nt, synthetic construct
  misc_feature 1..2088: note = derived and/or modified CDS sequence (opt5) from YFV__DQ322633__X-SS-prME-XX
  source 1..2088: mol_type = other RNA
atgggcctgagctccagaaagcggcgctctcacgacgtgctcaccgtccagttcctgatccttgggatgctgctcatgacaggaggcgttacgctggtgcggaaaaacagatggcttctgctcaatgtgaccagcgaggatctggggaagacattttccgtcggaaccggcaactgcacaaccaatattctggaagccaaatactggtgtcccgactctatggagtataactgccctaatctcagcccgcgcgaagaacccgatgacatcgattgttggtgctacggggtggaaaacgttagagtggcttatggaaagtgtgactccgccggccggtctcgcagaagccggcgcgcgattgatctgcctacacatgagaatcacggccttaaaaccagacaagagaagtggatgacggggcggatgggagaacgccagctgcagaagatcgagagatggttcgtccggaacccctttttcgctgtgaccgccctcacaattgcctacctggttggctccaatatgacccagcgcgtggtcatcgcccttctggtgctcgctgtggggcctgcttatagcgcccattgcatcggaattacagacagagattttatcgaaggcgtccacgggggaacctgggtttctgcgacgctggagcaagacaaatgtgtgacagtgatggcccccgataagccttccctggacattagcctcgagaccgtcgctatcgatcggccggccgaagtgagaaaagtttgctacaacgctgtgctgacacatgtcaagattaatgacaaatgtccctctaccggcgaggcccaccttgcggaagagaacgaaggcgacaatgcctgcaagcgcacctattccgatcgggggtggggaaacggctgtgggctgttcggaaagggcagcatcgtggcttgcgccaaatttacatgcgctaagtctatgtccctcttcgaggttgaccagacgaaaattcagtacgtgatcagagcccagctgcacgtcggggccaagcaagagaattggaacaccgatatcaaaacacttaagtttgacgctctgagcggatcccaggaagtggagttcattggctacggcaaagcgaccctcgaatgtcaggtccagacagccgtggattttgggaactcttatatcgctgagatggaaaccgagagctggattgttgaccgccaatgggcccaggatctgacgctgccttggcagtccggaagcggcggggtgtggcgggagatgcatcacctcgtcgagttcgagccccctcatgccgctacaatcagagtgctggcccttggaaatcaagaaggctctctgaagaccgcgctcaccggggctatgcgcgttacaaaggacaccaacgataataacctgtacaaacttcacggcggacacgtgtcctgccgggtcaagctgagcgccctcacactgaaaggcacgtcttataagatttgtaccgacaaaatgtttttcgtgaagaatcccacagataccgggcatggaacagtggttatgcaggtcaaggtgagcaaaggcgccccgtgcagaatccctgtgatcgtcgctgacgacctgaccgccgctattaacaaggggatcctcgtgacggttaatcccattgcctccaccaacgatgacgaggtgctgatcgaagtcaatcctcccttcggagattcttacattatcgtgggccgcggggacagccggcttacatatcagtggcacaaagagggctccagcatcggaaagctgtttacccagacaatgaaaggcgttgagagactcgcggtgatgggggataccgcctgggacttctcttccgctggaggctttttcacgagcgtcgggaagggcattcatacagtgtttggatctgccttccaagggctgtttggcggactgaactggatcaccaaggttattatgggcgctgtgcttatctgggtcgggattaatacacgcaacatgaccatgtccatgagcatgatcctcgtgggagtgattatgatgttcctgtccctgggcgtcggggccgatcagggatgtgcgatcaattttggcaaa

SEQ ID NO: 848 - RNA, 2067 nt, synthetic construct
  misc_feature 1..2067: note = derived and/or modified CDS sequence (opt5) from YFV__DQ322634__X-SS-prME-XX
  source 1..2067: mol_type = other RNA
atgagaagccacgacgtgctgaccgtccagttcctcatcctgggcatgcttctgatgacagggggagttacgctcgtgcggaagaaccgctggctgcttctgaatgtgacctccgaggatctcggcaaaacattttctgtcgggaccggaaactgcacaaccaatattctggaagccaagtactggtgtcccgacagcatggagtataactgccctaatctgtccccgagagaagaacccgatgacatcgattgttggtgctacggcgtggaaaacgttcgggtggcttatgggaaatgtgactctgccggacgcagcagacggtcccgcagagcgattgatctccctacacatgagaatcacggcctgaagacccggcaagagaaatggatgacgggccgcatgggggaaagacagcttcagaagatcgagcggtggttcgtccgcaacccctttttcgctgtgaccgccctgacaattgcctacctcgttggatctaatatgacccagagagtggtcatcgctctgcttgtgctggccgtgggccctgcttatagcgcccattgcatcgggattacagaccgggattttatcgaaggagtccacggcgggacctgggtttccgcgacgctcgagcaagacaagtgtgtgacagtgatggcccccgataaacctagcctggacatttctctggagaccgtcgctatcgatcgcccggccgaagtgagaaaggtttgctacaacgctgtgctcacacatgtcaaaattaatgacaagtgtccctccaccggagaggcccacctggcggaagagaacgaaggcgacaatgcctgcaaacggacctatagcgatagaggctgggggaacggatgtggccttttcgggaagggatctatcgtggcttgcgccaagtttacatgcgctaaatccatgagcctgttcgaggttgaccagacgaagattcagtacgtgatccgcgcccagctccacgtcggcgccaaacaagagaattggaacaccgatatcaagacactgaaatttgacgctctttctgggtcccaggaagtggagttcattggatacggcaaggcgaccctggaatgtcaggtccagacagccgtggattttggcaacagctatatcgctgagatggaaaccgagtcctggattgttgaccggcaatgggcccaggatctcacgctgccttggcagtctgggagcggaggcgtgtggagagagatgcatcacctggtcgagttcgagccccctcatgccgctacaatccgcgtgctcgccctggggaatcaagaaggatcccttaaaaccgcgctgaccggcgctatgcgggttacaaaggacaccaacgataataacctctacaagctgcacgggggccacgtgagctgcagagtcaaactttctgccctgacactcaagggaacgtcctataaaatttgtaccgacaagatgtttttcgtgaaaaatcccacagataccggccatgggacagtggttatgcaggtcaaggtgagcaagggagccccgtgccgcatccctgtgatcgtcgctgacgacctgaccgccgctattaacaaaggcatcctggtgacggttaatcccattgcctctaccaacgatgacgaggtgctcatcgaagtcaatcctcccttcggggatagctacattatcgtgggacggggcgactccagactgacatatcagtggcacaaggaggggtctagcatcggcaaactttttacccagacaatgaagggagttgagcgcctggcggtgatgggcgataccgcctgggacttctccagcgctgggggatttttcacgtctgtcggcaaagggattcatacagtgtttggatccgccttccaaggcctctttgggggcctgaactggatcaccaaggttattatgggagctgtgctgatctgggtcggcattaatacacggaacatgaccatgagcatgtctatgatccttgtgggggtgattatgatgttcctctccctgggagtcggcgccgatcaggggtgtgcgatcaattttggaaag

SEQ ID NO: 849 - RNA, 2061 nt, synthetic construct
  misc_feature 1..2061: note = derived and/or modified CDS sequence (opt5) from YFV__DQ322642__X-SS-prME-XX
  source 1..2061: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaacaccgatatcaaaacacttaagtttgacgctctgagcggatcccaggaagtggagttcattggctacggcaaagcgaccctcgaatgtcaggtccagacagccgtggattttgggaactcttatatcgctgagatggaaaccgagagctggattgttgaccggcaatgggcccaggatctgacgctgccttggcagtccggaagcggcggggtgtggagagagatgcatcacctcgtcgagttcgagccccctcatgccgctacaatccgcgtgctggcccttggaaatcaagaaggctctctgaagaccgcgctcaccggggctatgcgggttacaaaggacaccaacgataataacctgtacaaacttcacggcggacacgtgtcctgcagagtcaagctgagcgccctcacactgaaaggcacgtcttataagatttgtaccgacaaaatgtttttcgtgaagaatcccacagataccgggcatggaacagtggttatgcaggtcaaggtgagcaaaggcgccccgtgccgcatccctgtgatcgtcgctgacgacctgaccgccgctattaacaaggggatcctcgtgacggttaatcccattgcctccaccaacgatgacgaggtgctgatcgaagtcaatcctcccttcggagattcttacattatcgtgggccggggagacagcagacttacatatcagtggcacaaagagggctccagcatcggaaagctgtttacccagacaatgaaaggcgttgagcgcctcgcggtgatgggggataccgcctgggacttctcttccgctggaggctttttcacgagcgtcgggaaggggattcatacagtgtttggctctgccttccaagggctgtttggcggactgaactggatcaccaaggttattatgggcgctgtgcttatctgggtcgggattaatacacggaacatgaccatgtccatgagcatgatcctcgtgggagtgattatgatgttcctgtccctgggcgtcggggcc

SEQ ID NO: 850 - RNA, 2091 nt, synthetic construct
  misc_feature 1..2091: note = derived and/or modified CDS sequence (opt5) from YFV__GQ379162__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccccaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagctcgcaaagtgtgctacaacgccgttctgacacatgtgaagattaatgacaaatgtccctctaccggcgaggcgcaccttgccgaagagaacgaaggcgacaatgcttgcaagcggacctattccgatagagggtggggaaacggctgtgggctgttcggaaagggcagcatcgtcgcctgcgctaaatttacatgcgccaagtctatgtccctcttcgaggtggaccagacgaaaattcagtacgttatccgcgcccagctgcacgtgggggctaagcaagagaattggaacaccagcatcaaaacacttaagtttgatgcgctgtccggatctcaggaagtcgagttcattggctacggcaaagccaccctcgaatgtcaggtgcagacagctgtcgactttgggaacagctatatcgccgagatggaaaccgagtcctggattgtggatcggcaatgggcccaggacctgacgctgccttggcagagcggatctggcggggtttggagagagatgcatcacctcgtggagttcgagccccctcatgctgccacaatccgcgtcctggcgcttggaaatcaagaaggctccctgaagaccgctctcaccggggccatgcgggtgacaaaggataccaacgacaataacctgtacaaacttcacggcggacacgttagctgcagagtgaagctgtctgccctcacactgaaaggcacgagctataagatttgtaccgataaaatgtttttcgtcaagaatcccacagacaccgggcatggaacagtggtgatgcaggttaaggtcccgaaaggcgctccttgccgcatccccgtgatcgtggccgatgacctgaccgctgccattaacaaggggatcctcgtcacggtgaatcctattgcgtccaccaacgacgatgaggttctgatcgaagtgaatcctcccttcggagactcttacattatcgtcggccggggagatagcagacttacatatcagtggcacaaagagggctccagcatcggaaagctgtttacccagacaatgaaaggcgtggagcgcctcgccgttatgggggacgtggcttgggatttctcttccgccggaggctttttcaccagcgtcgggaaggggattcatacggtgtttggctctgctttccaagggctgtttggcggactgaactggatcacaaaggttattatgggcgccgtgcttatctgggtcgggattaatacccggaacatgacaatgtccatgagcatgatcctcgtgggagtgattatgatgttcctgtccctgggcgtcggggcggaccagggatgtgccatcaattttggcaaa

SEQ ID NO: 851 - RNA, 2085 nt, synthetic construct
  misc_feature 1..2085: note = derived and/or modified CDS sequence (opt5) from YFV__DQ859065__X-SS-prME-XX
  source 1..2085: mol_type = other RNA
atgctgaagggcgtgagcgggagaaagaagcggcgctccgtcgaggccaccggattcgtttctacactcctgtttggcatcgtgcttacggctagcgtgtccagacacgcccatcacaccctgctcaacgtcacaaaagaagacaccaatcagattctgacacttcggaacgggaattgcaccgtggtttctatggatgtgggaagctggtgtgacgataacgtcgagtacgactgcgtgacactgcaagataatgaagaacccgacgatgttgactgttggtgctataaggtgaacggcgtccgcgtgacctacgggaaatgtagagaaggaaatacgcctcggcgctccaagagagcggtggtcatcaccgctcatctcgatcagggcctgacaaccaagaaagagacatggctgggctctagccacttcgagacccagattcagaagatcgaaaaatggattatccggaacccgacgtatgccatcgccgctattatcatggcctggtacattgggaactccacaaagcaacgcgttgtgctcctgcttctgaccctcgctctgggacccgcctatgcgacacattgcgtgggcatcgccaaaagagactttgtccagggggtgcagggaaccacctgggttaacgtggtcatggagcagggcgcttgtgtgacaattgttacggaagggaagcctagcgtggatgtctggatggagggaatcaccttctcttcccccacaatggtgcggcgcattagccacaccgccacaatctctgacaccaagatctccagcgcttgcccttctacgggcgaggccaaacttgatgaggagcacgacaagacatttgaatgtaaaagaacctactccgaccggggctgggggaatggatgcggcctgttcgggaagggaagcattgtcgcgtgtgccaaatttacctccacaggccatatggatgtgtatgagatggacatgaccaaggttgaatacacaatcaaaacgcaagtgcactctggggctaagagcgatgacaccacaggagtcaaggagattaaattcacccccgtgtccggcacacagaccgttgagtttcctggctacgggaacctcggactggaatgcatcgtgcagagcgatattgacttcacgacccattatctggtcgtgctcggcacagatgcctggctggtgcacaaggcttgggttgaggacgtcacccttccgtggaaacacgaaggggccgcctcttggcgcgataagcagtacctggtggagtttggagaaccccatgctgcgacaatcaaagtgctcgtcctgggctcccaagagggggcccttagaaccgctctggccggcgccatgatggtgacgcacgacagctctgctaagacattcaagctccatggaggccacgttacctgcaaagccaagctgaatgatctggtgatcaaagggacaacctataccaactgtcggggaggcctcagctttgtcaagacacctacggacaccgggcatggaacagtggttatgcaagtgaaagtctccagaaatgcgccctgccgcctgaccgtgattgctgccgacgatgcctctggccacgttaaccgggggacacttgtgaccagcaaccctatcgctaattccaacaatgacgaggtcctggtggaagtgaatcccccgtacggcagctcttatctcattgtcggaacgggcgatgacaagctggtttaccagtggaagaaatccgggagctctatcggaaaacttttctccgagacagtgaaaggcgcccagagaatggctattgtggggagctcctcttgggatttcagctccgccggaggctttttctctagcgtcgggaaggcgctgcacaccgtgtttggcaccgccttccagggaatctttggcgggctctcctggatcacacgcgttctgattggagtgctgctcatctggctgggccttaatagccggaacgggatggctaccacagtcatgatgattacgggattcgtgatcctgtttctctctctgggcgttggggccgaaattggctgttccgtgaattggggacag

SEQ ID NO: 852 - RNA, 2091 nt, synthetic construct
  misc_feature 1..2091: note = derived and/or modified CDS sequence (opt5) from YFV__KU921608__X-SS-prME-XX
  source 1..2091: mol_type = other RNA
atgagaggcctggccagccggaagcgcagatccaacgagatggctctcttccccctgcttctgctcgggctgcttgccctgtctggaggcgtgaccctcgtccggaaaaatcgctggctgctgctcaacgttacagcggaagacctggggaagacgtttagcgtgggaaccggcaattgcacaaccaacatccttgaggctaaatactggtgtcctgattccatggaatataattgcccgaacctgtctcccagagaggaacctgacgatattgactgttggtgctacggggtggagaatgtccgggtggcctatggacgctgtgatgccgttggcagaagcaagcggtcccgcagagctatcgacctccccacacacgagaaccatggcctgaaaacccggcaggaaaagtggatgacagggcgcatgggagagagacaacttcagaagattgaacggtggctggtgcgcaatcctttctttgccgtcaccgctctcgccatcgcgtacctggtgggcaacaatacgacccagagagttgtgattgccctgctcgtcctggctgtggggcccgcctattctgctcactgcatcggaatcacagatcgggacttcattgagggcgtgcatgggggaacctgggtcagcgccacacttgagcaggataaatgtgttaccgtgatggcgcctgacaagccgtccctggatatcagcctccaaacggtggccattgacggccccgctgaagccagaaaagtctgctactctgctgtgctgacacacgttaagatcaacgataaatgtccttccaccggcgaggcccatcttgccgaagagaatgacggggacaacgcttgcaagcgcacatatagcgatcggggatggggcaatgggtgtggactgtttggcaaggggtctattgtggcgtgcgccaaatttacctgcgctaagtccatgagcctcttcgaagtcgaccagaccaaaatccagtacgtgattagagcccagctgcacgttggagccaagcaagagaactggaacacagatatcaaaacgctgaagttcgacgctctctctggctcccaggaggccgaatttaccggctacgggaaagcgacactggagtgtcaggtgcagaccgctgtcgatttcggaaatagctatatcgccgaaatggagaaggactcctggattgtggatcgccaatgggcccaggaccttacactgccctggcagtctggcagcgggggaatctggcgggaaatgcaccatctcgtcgagtttgagcctccccacgctgccaccattagagtgctggctcttggcaaccaagaagggtccctgaagacggccctcacaggcgcgatgcgcgttaccaaagatgagaatgacaacaatctgtacaagctgcatggaggccacgtgagctgccgggtcaaactctctgccctgacccttaaggggacatcctataaaatgtgtaccgataagatgagcttcgtgaagaacccgacagacacgggacacggcaccgttgtgatgcaggtcaaagtgcctaagggggctccctgcaaaatccctgtgattgttgccgacgatctgacagctgccgtcaataagggaatcctcgtgaccgtgaaccccatcgcgtctacaaatgacgatgaagtcctgattgaggtgaatcccccttttggcgacagctacatcattgttgggaccggcgattccagactgacgtatcagtggcataaagaaggatctagcatcggcaaacttttcacccagacaatgaagggggccgagcgcctcgctgtgatgggagacgccgcttgggatttctccagcgccggcgggtttttcacctctgtcggaaagggcattcacacagtgtttgggtccgccttccaaggcctgtttggaggcctgagctggatcaccaaggttatcatgggggctgtgctcatttgggtcggaatcaacacgcggaacatgacaatgtctatgtccatgattctggtgggcgttatcatgatgttccttagcctgggggtgggagcggaccagggctgtgccgtcaattttgggaaa

SEQ ID NO: 853 - RNA, 2091 nt, synthetic construct
  misc_feature 1..2091: note = derived and/or modified CDS sequence (opt5) from YFV__KX010994__X-SS-prME-XX
  source 1..2091: mol_type = other RNA
atgagaggcctgagctcccggaagcgcagatctaacgagatggccatgttccccctcctgcttctggggctcctggctcttagcggaggcgtgaccctggtccggaaaaatcgctggctcctgctgaacgttacagccgaagacctcgggaagacgttttccgtgggaaccggcaattgcacaaccaacatcctggaggcgaaatactggtgtcctgattctatggaatataattgcccgaaccttagccccagagaggaacctgacgatattgactgttggtgctacggggtggagaatgtccgggtggcttatggacgctgtgatgccgttggcagatccaagcggtctcgcagagccatcgacctgcccacacacgagaaccatggcctcaaaacccggcaggaaaagtggatgacagggcgcatgggagagagacaactgcagaagattgaacggtggcttgtgcgcaatcctttctttgctgtcaccgccctggctatcgcctacctcgtgggcaacaatacgacccagagagttgtgattgcgctgctggtcctcgccgtggggcccgcttatagcgcccactgcatcggaatcacagatcgggacttcattgagggcgtgcatgggggaacctgggtctccgctacactggagcaggataaatgtgttaccgtgatggcccctgacaagccgagccttgatatctctctgcaaacggtggcgattgacggccccgccgaagctagaaaagtctgctactccgccgtgctcacacacgttaagatcaacgataaatgtcctagcaccggcgaggctcatctggccgaagagaatgacggggacaacgcctgcaagcgcacatattctgatcggggatggggcaatgggtgtggactttttggcaaggggtccattgtggcttgcgcgaaatttacctgcgccaagagcatgtctctgttcgaagtcgaccagaccaaaatccagtacgtgattagagctcagctccacgttggagccaagcaagagaactggaacacagatatcaaaacgctgaagttcgacgccctgtccggcagccaggaggctgaatttaccggctacgggaaagccacactcgagtgtcaggtgcagaccgcggtcgatttcggaaattcctatatcgctgaaatggagaaggactcttggattgtggatcgccaatgggcccaggacctgacacttccctggcagagcggctccgggggaatctggcgggaaatgcaccatctggtcgagtttgagcctccccacgccgctaccattagagtgctcgccctgggcaaccaagaagggagccttaagacggctctgacaggcgccatgcgcgttaccaaagatgagaatgacaacaatctctacaagctgcatggaggccacgtgtcttgccgggtcaaactgtccgcgctcaccctgaaggggacaagctataaaatgtgtaccgataagatgtctttcgtgaagaacccgacagacacgggacacggcaccgttgtgatgcaggtcaaagtgcctaagggggccccctgcaaaatccctgtgattgttgctgacgatcttacagccgctgtcaataagggaatcctggtgaccgtgaaccccatcgccagcacaaatgacgatgaagtcctcattgaggtgaatcccccttttggcgactcctacatcattgttgggaccggcgattctagactgacgtatcagtggcataaagaaggaagctccatcggcaagctgttcacccagacaatgaagggggcggagcgccttgccgtgatgggagacgctgcctgggatttcagctctgctggcgggtttttcacctccgtcggaaaaggcattcacacagtgtttgggagcgccttccaaggcctctttggaggcctgtcttggatcaccaaggttatcatgggggccgtgctgatttgggtcggaatcaacacgcggaacatgacaatgtccatgagcatgattctcgtgggcgttatcatgatgttcctgtcccttggggtgggagctgaccagggctgtgcggtcaattttgggaaa

SEQ ID NO: 854 - RNA, 2091 nt, synthetic construct
  misc_feature 1..2091: note = derived and/or modified CDS sequence (opt5) from YFV__KX027336__X-SS-prME-XX
  source 1..2091: mol_type = other RNA
atgagaggcctggccagccggaagcgcagatccaacgagatggctatggtgcccctcctgcttctggggctcctggccctttctggaggcgtcaccctggttcggaaaaatcgctggctcctgctgaacgtgacagcggaagacctcgggaagacgttcagcgtgggaaccggcaattgcacaaccaacatcctggaggctaaatactggtgtcctgattccatggaatataattgcccgaacctttctcccagagaggaacctgacgatattgactgttggtgctacggggtcgagaatgtgcgggttgcctatggacgctgtgatgccgtgggcagaagcaagcggtcccgcagagctatcgacctgcccacacacgagaaccatggcctcaaaacccggcaggaaaagtggatgacagggcgcatgggagagagacaactgcagaagattgaacggtggcttgtccgcaatccctttttcgccgtgaccgctctggccatcgcgtacctcgttggcaacaatacgacccagagagtggtcattgccctgctggtgctcgctgtggggcccgcctattctgctcactgcatcggaatcacagatcgggactttattgagggcgtccatgggggaacctgggttagcgccacactggagcaggataaatgtgtgaccgtgatggcgcctgacaagccgtcccttgatatcagcctgcaaacggtcgccattgacggccccgctgaagccagaaaagtgtgctactctgctgttctcacacacgtgaagatcaacgataaatgtccttccaccggcgaggcccatctggccgaagagaatgacggggacaacgcttgcaagcgcacatatagcgatcggggatggggcaatgggtgtggacttttcggcaaggggtctattgtcgcgtgcgccaaatttacctgcgctaagtccatgagcctgttcgaagtggaccagaccaaaatccagtacgttattagagcccagctccacgtgggagccaagcaagagaactggaacacagatatcaaaacgctgaagtttgacgctctgtctggctcccaggaggccgagttcaccggctacgggaaagcgacactcgaatgtcaggtccagaccgctgtggattttggaaatagctatatcgccgaaatggagaaggactcctggattgtcgatcgccaatgggcccaggacctgacacttccctggcagtctggcagcgggggaatctggcgggaaatgcaccatctggtggagttcgagcctccccacgctgccaccattagagttctcgctctgggcaaccaagaagggtcccttaagacggccctgacaggcgcgatgcgcgtgaccaaagatgagaatgacaacaatctctacaagctgcatggaggccacgtcagctgccgggtgaaactgtctgccctcaccctgaaggggacatcctataaaatgtgtaccgataagatgagctttgttaagaacccgacagacacgggacacggcaccgtggtcatgcaagtgaaagtgcctaagggggctccctgcaaaatccctgttattgtcgccgacgatcttacagctgccgtgaataagggaatcctggtgaccgtcaaccccatcgcgtctacaaatgacgatgaagtgctcattgaggttaaccctcctttcggcgacagctacatcattgtggggaccggcgattccagactgacgtatcagtggcataaagaaggatctagcatcggcaagctgtttacccagacaatgaagggggccgagcgccttgctgtcatgggagacgccgcttgggatttctccagcgccggcgggttctttacctctgtgggaaaaggcattcacacagttttcgggtccgcctttcagggcctcttcggaggcctgagctggatcaccaaggtgatcatgggggctgtcctgatttgggtgggaatcaatacgcggaacatgacaatgtctatgtccatgattctcgttggcgtgatcatgatgtttctgagccttggggtcggagcggaccagggctgtgccgtgaatttcgggaaa

SEQ ID NO: 855 - RNA, 2091 nt, synthetic construct
  misc_feature 1..2091: note = derived and/or modified CDS sequence (opt5) from YFV__JX898868__X-SS-prME-XX
  source 1..2091: mol_type = other RNA
atgagaggcctgagctcccggaagcgcagatctcacgacgccctcgctgtgcagttcctgatccttgggatgctgctcatggccggaggcgtcaccctggttcggaaaaaccgctggcttctgctcaatgtgacaagcgaggatctggggaagacgttttccgtgggaaccggcaactgcacaaccaatattctggaagcgaaatactggtgtcccgactctatggagtataactgccccaatctcagcccgagagaggaacccgatgacatcgattgttggtgctacggggtcgaaaacgtgcgggttgcttatggaaagtgtgactccgccggccgctctagacggagccgcagagccattgatctgcctacacatgagaatcacggccttaaaacccggcaagagaagtggatgacagggcgcatgggagaaagacagctgcagaagatcgagcggtggctcgtgcgcaaccccttctttgctgtcaccgccctgacgattgcttaccttgtgggctccaatatgatgcagagagttgtgatcgccctgctcgtcctggcggtggggcctgcctatagcgctcattgcatcggaattaccgaccgggatttcatcgaaggcgtgcacgggggaacatgggtctctgccaccctggagcaagacaaatgtgttacagtgatggctcccgataagccttccctcgacattagcctggagaccgtggccatcgatggcccggcggaagccagaaaagtctgctacaacgctgtgcttacgcatgttaagattaatgacaaatgtccctctacaggcgaggcccacctggctgaagagaacgaaggggacaatgcctgcaagcgcacctattccgatcggggatggggcaacgggtgtggactctttggcaaggggagcatcgtggcctgcgctaaattcacatgcgcgaagtctatgtccctgtttgaggtcgaccagaccaaaattcagtacgtgatcagagcccagcttcacgttggagctaagcaagagaattggaacaccgatatcaaaacactgaagttcgacgccctcagcggctcccaggaagccgagtttacgggctacgggaaagctaccctggaatgtcaggtgcagacagccgtcgatttcggaaactcttatattgcggagatggaaaaggagagctggatcgtggaccgccaatgggctcaggatctgaccctcccttggcagtccggcagcgggggagtctggcgggagatgcatcacctggtggaatttgagccccctcatgccgccacaattagagttcttgctctgggcaatcaagaagggtctctcaagaccgccctgacgggcgctatgcgcgtgacaaaagacaccaacgataataacctttacaagctgcacggaggccacgtctcctgccgggtgaaactcagcgccctgaccctgaaggggacatcttataaaatgtgtaccgacaagatgagcttcgttaagaatcccacagatacgggacatggcaccgtggtcatgcaagtgaaagtgccgaagggggcgccttgcaaaatccccgttattgtcgccgacgacctcacagctgccatcaacaagggaatcctggtgaccgtgaatcctattgcttccacaaacgatgacgaggtccttatcgaagtgaatcctccctttggcgattcttacattatcgttgggaccggcgacagcagactgacgtatcagtggcacaaagagggatccagcattggcaaactcttcacccagacaatgaagggggccgagcgcctggcggtgatgggagatgccgcttgggacttctcttccgccggcgggtttttcaccagcgtcggaaagggcatccatacagtgtttgggtctgctttccagggcctgtttggaggcctttcctggatcaccaaggttattatgggggccgtgctcatctgggtcggaattaacacgcggaatatgacaatgagcatgtccatgatcctggtgggcgttattatgatgttcctgtctctcggggtgggagccgatcagggctgtgctatcaactttgggaaa

SEQ ID NO: 856 - RNA, 2091 nt, synthetic construct
  misc_feature 1..2091: note = derived and/or modified CDS sequence (opt5) from YFV__JX898869__X-SS-prME-XX
  source 1..2091: mol_type = other RNA
atgagaggcctgagctcccggaagcgcagatctcacgacgtgctcaccgtccagttcctgatccttgggatgctgctcatggccggaggcgttacactggtgcggaaaaaccgctggcttctgctcaatgtgacgagcgaggatctggggaagaccttttccgtcggaacaggcaactgcaccacaaatattctggaagctaaatactggtgtcccgactctatggagtataactgccccaatctcagcccgagagaggaacccgatgacatcgattgttggtgctacggggtggaaaacgttcgggtggcctatggaaagtgtgactccgcgggccgctctagacggagccgcagagctattgatctgcctacccatgagaatcacggccttaaaacacggcaagagaagtggatgaccgggcgcatgggagaaagacagctgcagaagatcgagcggtggctcgtccgcaaccccttctttgccgtgacggccctgaccattgcttaccttgttggctccaatatgacacagagagtggtcatcgccctgctcgtgctggctgtggggcctgcctatagcgcgcattgcatcggaattaccgaccgggatttcatcgaaggcgtccacgggggaacatgggtttctgccaccctggagcaagacaaatgtgtgacggtgatggctcccgataagccttccctcgacattagcctggagacagtcgccatcgatggcccggctgaagccagaaaagtgtgctacaacgcggttcttacccatgtgaagattaatgacaaatgtccctctacaggcgaggcccacctggctgaagagaacgaaggggacaatgcctgcaagcgcacctattccgatcggggatggggcaacgggtgtggactctttggcaaggggagcatcgtcgcttgcgccaaatttacctgcgccaagtctatgtccctgttcgaggtggaccagacaaaaattcagtacgttatcagagctcagcttcacgtgggagcgaagcaagagaattggaacacggatatcaaaaccctgaagttcgacgccctcagcggctcccaggaagctgagtttacaggctacgggaaagccaccctggaatgtcaggtccagacagccgtggatttcggaaactcttatattgctgagatggaaaaggagagctggatcgtcgaccgccaatgggcccaggatctgaccctcccttggcagtccggcagcgggggagtgtggcgggagatgcatcacctggttgaatttgagccccctcatgcggctacgattagagtgcttgccctgggcaatcaagaagggtctctcaagacagccctgaccggcgctatgcgcgtcaccaaagacacaaacgataataacctttacaagctgcacggaggccacgtgtcctgccgggttaaactcagcgccctgaccctgaaggggacatcttataaaatgtgtacggacaagatgagcttcgtgaagaatcccaccgatacaggacatggcaccgtcgtgatgcaagtgaaagttccgaagggggctccttgcaaaatccccgtcattgtggccgacgacctcacagcggccgtgaacaagggaatcctggtcaccgtgaatcctatcgcttccacgaacgatgacgaggttcttattgaagtgaatcctccctttggcgattcttacatcattgtcgggaccggcgacagcagactgacatatcagtggcacaaagagggatccagcatcggcaaactcttcacccagacaatgaagggggccgagcgcctggctgtgatgggagatgccgcgtgggacttctcttccgccggcgggtttttcaccagcattggaaagggcatccatacggtttttgggtctgctttccagggcctgtttggaggcctttcctggatcacaaaggtgattatgggggccgtcctcatctgggtgggaattaacacccggaatatgacaatgagcatgtccatgatcctggttggcgtgattatgatgttcctgtctctcggggtcggagctgatcagggctgtgccatcaactttgggaaa

SEQ ID NO: 857 - RNA, 2091 nt, synthetic construct
  misc_feature 1..2091: note = derived and/or modified CDS sequence (opt5) from YFV__JX898873__X-SS-prME-XX
  source 1..2091: mol_type = other RNA
atgagaggcctgagctcccggaagcgcagatctcacgacgccctcaccgtgcagctgcttatcctggggatgattctcatggctggaggcgtcacactggttcggaaaaaccgctggcttctgctcaatgtgacgagcgaggatctggggaagaccttctccgtgggaacaggcaactgcaccacaaatatcctggaagccaaatactggtgtcccgactctatggagtataactgccccaatctcagcccgagagaagaacccgatgacattgattgttggtgctacggggtcgaaaacgtgcgggttgcgtatggaaagtgtgactccgctggccgctctagacggagccgcagagccatcgatctgcctacccatgagaatcacggccttaaaacacggcaagagaagtggatgaccgggcgcatgggagaaagacagctgcagaagattgagcggtggctcgtgcgcaacccctttttcgccgtcacggctctgaccatcgcctaccttgtgggctccaatatgacacagagagttgtgatcgctctgctcgtcctggccgtggggcctgcgtatagcgcccattgcattggaatcaccgaccgggattttattgaaggcgtgcacgggggaacatgggtctctgctaccctggagcaagacaaatgtgttacggtgatggcccccgataagccttccctcgacatcagcctggagacagtggctattgatggcccggccgaagcgagaaaagtctgctacaacgccgtgcttacccatgttaagatcaatgacaaatgtccctctacaggcgaggctcacctggccgaagagaacgaaggggacaatgcttgcaagcgcacctattccgatcggggatggggcaacgggtgtggactcttcggcaaggggagcattgtggcctgcgccaaatttacctgcgctaagtctatgtccctgttcgaggtcgaccagacaaaaatccagtacgtgatcagagcgcagcttcacgttggagccaagcaagagaattggaacacggatattaaaaccctgaagtttgacgctctcagcggctcccaggaagccgagttcacaggctacgggaaagccaccctggaatgtcaggtgcagacagctgtcgattttggaaactcttatatcgccgagatggaaaaggagagctggattgtggaccgccaatgggcgcaggatctgaccctcccttggcagtccggcagcgggggagtctggcgggagatgcatcacctggtggagttcgagccccctcatgctgccacgatcagagttcttgccctgggcaatcaagaagggtctctcaagacagctctgaccggcgccacccgcgtgacaaaagacaccaacgataataacctttacaagctgcacggaggccacgtctcctgccgggtgaaactcagcgctctgacactgaaggggacgtcttataaaatgtgtaccgacaagatgagctttgttaagaatcccacagataccggacatggcacagtggtcatgcaagtgaaagtgccgaagggggccccttgcaaaattcccgttatcgtcgcggacgacctcaccgccgctatcaacaagggcattctggtgacggtgaatcctatcgcctccaccaacgatgacgaggtccttattgaagtgaatcctcccttcggagattcttacatcattgttgggacaggcgacagcagactgacctatcagtggcacaaagagggatccagcatcggcaagctctttacacagaccatgaagggggctgagcgcctggccgtgatgggagatgcggcctgggacttctcttccgctggcgggttctttacgagcgtcggaaaaggcatccatacagtgttcgggtctgcctttcagggcctgttcggaggcctttcctggattaccaaggttatcatgggggctgtgctcatttgggtcggaatcaacacacggaatatgaccatgagcatgtccatgattctggtgggcgttatcatgatgtttctgtctctcggggtgggagccgatcagggctgtgccattaacttcgggaaa

SEQ ID NO: 858 - RNA, 2091 nt, synthetic construct
  misc_feature 1..2091: note = derived and/or modified CDS sequence (opt5) from YFV__JX898874__X-SS-prME-XX
  source 1..2091: mol_type = other RNA
atgagaggcctgagctcccggaagcgcagatctcacgacgccctcaccgtgcagctgcttatcctggggatgattctcatggctggaggcgtcacactggttcggaaaaaccgctggcttctgctcaatgtgacgagcgaggatctggggaagaccttctccgtgggaacaggcaactgcaccacaaatatcctggaagccaaatactggtgtcccgactctatggagtataactgccccaatctcagcccgagagaagaacccgatgacattgattgttggtgctacggggtcgaaaacgtgcgggttgcgtatggaaagtgtgactccgctggccgctctagacggagccgcagagccatcgatctgcctacccatgagaatcacggccttaaaacacggcaagagaagtggatgaccgggcgcatgggagaaagacagctgcagaagattgagcggtggctcgtgcgcaacccctttttcgccgtcacggctctgaccatcgcctaccttgtgggctccaatatgacacagagagttgtgatcgctctgctcgtcctggccgtggggcctgcgtatagcgcccattgcattggaatcaccgaccgggattttattgaaggcgtgcacgggggaacatgggtctctgctaccctggagcaagacaaatgtgttacggtgatggcccccgataagccttccctcgacatcagcctggagacagtggctattgatggcccggccgaagcgagaaaagtctgctacaacgccgtgcttacccatgttaagatcaatgacaaatgtccctctacaggcgaggctcacctggccgaagagaacgaaggggacaatgcttgcaagcgcacctattccgatcggggatggggcaacgggtgtggactcttcggcaaggggagcattgtggcctgcgccaaatttacctgcgctaagtctatgtccctgttcgaggtcgaccagacaaaaatccagtacgtgatcagagcgcagcttcacgttggagccaagcaagagaattggaacacggatattaaaaccctgaagtttgacgctctcagcggctcccaggaagccgagttcacaggctacgggaaagccaccctggaatgtcaggtgcagacagctgtcgattttggaaactcttatatcgccgagatggaaaaggagagctggattgtggaccgccaatgggcgcaggatctgaccctcccttggcagtccggcagcgggggagtctggcgggagatgcatcacctggtggagttcgagccccctcatgctgccacgatcagagttcttgccctgggcaatcaagaagggtctctcaagacagctctgaccggcgccatgcgcgtgaccaaagacacaaacgataataacctttacaagctgcacggaggccacgtctcctgccgggtgaaactcagcgctctgaccctgaaggggacatcttataaaatgtgtacggacaagatgagctttgttaagaatcccaccgatacaggacatggcaccgtggtcatgcaagtgaaagtgccgaagggggccccttgcaaaattcccgttatcgtcgcggacgacctcacagccgctatcaacaagggcattctggtgaccgtgaatcctatcgcctccacgaacgatgacgaggtccttattgaagtgaatcctcccttcggagattcttacatcattgttgggaccggcgacagcagactgacatatcagtggcacaaagagggatccagcatcggcaagctctttacccagacaatgaagggggctgagcgcctggccgtgatgggagatgcggcctgggacttctcttccgctggcgggttctttaccagcgtcggaaaaggcatccatacggtgttcgggtctgcctttcagggcctgttcggaggcctttcctggattacaaaggttatcatgggggctgtgctcatttgggtcggaatcaacacccggaatatgacaatgagcatgtccatgattctggtgggcgttatcatgatgtttctgtctctcggggtgggagccgatcagggctgtgccattaacttcgggaaa

SEQ ID NO: 859 - RNA, 2091 nt, synthetic construct
  misc_feature 1..2091: note = derived and/or modified CDS sequence (opt5) from YFV__JX898875__X-SS-prME-XX
  source 1..2091: mol_type = other RNA
atgagaggcctgagctcccggaagcgcagatctcacgacgccctcaccgtgcagctgcttatcctggggatgattctcatggctggaggcgtcacactggttcggaaaaaccgctggcttctgctcaatgtgacgagcgaggatctggggaagaccttctccgtgggaacaggcaactgcaccacaaatatcctggaagccaaatactggtgtcccgactctatggagtataactgccccaatctcagcccgagagaggaacccgatgacattgattgttggtgctacggggtcgaaaacgtgcgggttgcgtatggaaagtgtgactccgctggccgctctagacggagccgcagagccatcgatctgcctacccatgagaatcacggccttaaaacacggcaagagaagtggatgaccgggcgcatgggagaaagacagctgcagaagattgagcggtggctcgtgcgcaacccctttttcgccgtcacggctctgaccatcgcctaccttgtgggctccaatatgacacagagagttgtgatcgctctgctcgtcctggccgtggggcctgcgtatagcgcccattgcattggaatcaccgaccgggattttattgaaggcgtgcacgggggaacatgggtctctgctaccctggagcaagacaaatgtgttacggtgatggcccccgataagccttccctcgacatcagcctggagacagtggctattgatggcccggccgaagcgagaaaagtctgctacaacgccgtgcttacccatgttaagatcaatgacaaatgtccctctacaggcgaggctcacctggccgaagagaacgaaggggacaatgcttgcaagcgcacctattccgatcggggatggggcaacgggtgtggactcttcggcaaggggagcattgtggcctgcgccaaatttacctgcgctaagtctatgtccctgttcgaggtcgaccagacaaaaatccagtacgtgatcagagcgcagcttcacgttggagccaagcaagagaattggaacacggatattaaaaccctgaagtttgacgctctcagcggctcccaggaagccaaattcacaggctacgggaaggccaccctggagtgtcaggtgcagacagctgtcgattttggaaactcttatatcgccgaaatggagaaggaaagctggattgtggaccgccaatgggcgcaggatctgaccctcccttggcagtccggcagcgggggagtctggcgggagatgcatcacctggtggagttcgaaccccctcatgctgccacgatcagagttcttgccctgggcaatcaagaggggtctctcaaaacagctctgaccggcgccatgcgcgtgaccaaggacacaaacgataataacctttacaaactgcacggaggccacgtctcctgccgggtgaagctcagcgctctgaccctgaaagggacatcttataagatgtgtacggacaagatgagctttgttaaaaatcccaccgatacaggacatggcaccgtggtcatgcaagtgaaggtgccgaaaggggccccttgcaagattcccgttatcgtcgcggacgacctcacagccgctatcaacaaaggcattctggtgaccgtgaatcctatcgcctccacgaacgatgacgaagtccttattgaggtgaatcctcccttcggagattcttacatcattgttgggaccggcgacagcagactgacatatcagtggcacaaggaaggatccagcatcggcaagctctttacccagacaatgaaaggggctgagcgcctggccgtgatgggagatgcggcctgggacttctcttccgctggcgggttctttaccagcgtcggaaagggcatccatacggtgttcgggtctgcctttcagggcctgttcggaggcctttcctggattacaaaagttatcatgggggctgtgctcatttgggtcggaatcaacacccggaatatgacaatgagcatgtccatgattctggtgggcgttatcatgatgtttctgtctctcggggtgggagccgatcagggctgtgccattaacttcgggaag

SEQ ID NO: 860 - RNA, 2091 nt, synthetic construct
  misc_feature 1..2091: note = derived and/or modified CDS sequence (opt5) from YFV__JX949181__X-SS-prME-XX
  source 1..2091: mol_type = other RNA
atgagaggcctgagctcccggaagcgcagatctcacgacgtgctcaccgtccagttcctgatccttgggatgctgctcatgacaggaggcgttacgctggtgcggaaaaaccgctggcttctgctcaatgtgaccagcgaggatctggggaagacattttccgtcggaaccggcaactgcacaaccaatattctggaagccaaatactggtgtcccgactctatggagtataactgccctaatctcagcccgagagaagaacccgatgacatcgattgttggtgctacggggtggaaaacgttcgggtggcttatggaaagtgtgactccgccggccgctctagacggagccgcagagcgattgatctgcctacacatgagaatcacggccttaaaacccggcaagagaagtggatgacggggcgcatgggagaaagacagctgcagaagatcgagcggtggttcgtccgcaacccctttttcgctgtgaccgccctcacaattgcctacctggttggctccaatatgacccagagagtggtcatcgcccttctggtgctcgctgtggggcctgcttatagcgcccattgcatcggaattacagaccgggattttatcgaaggcgtccacgggggaacctgggtttctgcgacgctggagcaagacaaatgtgtgacagtgatggcccccgataagccttccctggacattagcctcgagaccgtcgctatcgatagaccggccgaagtgcgcaaagtttgctacaacgctgtgctgacacatgtcaagattaatgacaaatgtccctctaccggcgaggcccaccttgcggaagagaacgaaggcgacaatgcctgcaagcggacctattccgatagagggtggggaaacggctgtgggctgttcggaaagggcagcatcgtggcttgcgccaaatttacatgcgctaagtctatgtccctcttcgaggttgaccagacgaaaattcagtacgtgatccgcgcccagctgcacgtcggggccaagcaagagaattggaccacagatatcaaaacccttaagtttgacgctctgagcggatcccaggaagtggagttcattggctacggcaaagcgacactcgaatgtcaggtccagaccgccgtggattttgggaactcttatatcgctgagatggaaacggagagctggattgttgaccggcaatgggcccaggatctgacactgccttggcagtccggaagcggcggggtgtggagagagatgcatcacctcgtcgagttcgagccccctcatgccgctaccatccgcgtgctggcccttggaaaccaagaaggctctctgaagaccgcgctcacaggggctatgcgggttaccaaggacacaaatgataacaatctgtacaaacttcacggcggacacgtgtcctgcagagtcaagctgagcgccctcacgctgaaaggcacctcttataagatttgtacagacaaaatgtttttcgtgaagaaccccaccgatacagggcatggaaccgtggttatgcaggtcaaggtgagcaaaggcgccccgtgccgcatccctgtgatcgtcgctgacgacctgacggccgctattaataaggggatcctcgtgaccgttaaccccattgcctccacaaatgatgacgaggtgctgatcgaagtcaaccctcccttcggagattcttacattatcgtgggccggggagacagcagacttacctatcagtggcacaaagagggctccagcatcggaaagctgtttacacagaccatgaaaggcgttgagcgcctcgcggtgatgggggatacggcctgggacttctcttccgctggaggctttttcacaagcgtcgggaaggggattcataccgtgtttggctctgccttccaagggctgtttggcggactgaattggatcacaaaggttattatgggcgtggtccttatctgggtggggattaacacccggaatatgaccatgtccatgagcatgatcctcgtgggagtcattatgatgttcctgtccctgggcgttggggctgatcagggatgtgccatcaactttggcaaa

SEQ ID NO: 861 - RNA, 2091 nt, synthetic construct
  misc_feature 1..2091: note = derived and/or modified CDS sequence (opt5) from YFV__AY968064__X-SS-prME-XX
  source 1..2091: mol_type = other RNA
atgagaggcctgagctcccggaagcgcagatctaacgagatggccctcttccccctgcttctgctcgggctgcttgctctgagcggaggcgtgaccctcgtccggaaaaatcgctggctgctgctcaacgttacagccgaagacctggggaagacgttttccgtgggaaccggcaattgcacaaccaacatccttgaggcgaaatactggtgtcctgattctatggaatataattgcccgaacctgagccccagagaggaacctgacgatattgactgttggtgctacggggtggagaatgtccgggtggcttatggacgctgtgatgccgttggcagatccaagcggtctcgcagagccatcgacctccccacacacgagaaccatggcctgaaaacccggcaggaaaagtggatgacagggcgcatgggagagagacaacttcagaagattgaacggtggctggtgcgcaatcctttctttgctgtcaccgccctcgctatcgcctacctggtgggcaacaatacgacccagagagttgtgattgcgctgctcgtcctggccgtggggcccgcttatagcgcccactgcatcggaatcacagatcgggacttcattgagggcgtgcatgggggaacctgggtctccgctacacttgagcaggataaatgtgttaccgtgatggcccctgacaagccgagcctggatatctctctccaaacggtggcgattgacggccccgccgaagctagaaaagtctgctactccgccgtgctgacacacgttaagatcaacgataaatgtcctagcaccggcgaggctcatcttgccgaagagaatgacggggacaacgcctgcaagcgcacatattctgatcggggatggggcaatgggtgtggactgtttggcaaggggtccattgtggcttgcgcgaaatttacctgcgccaagagcatgtctctcttcgaagtcgaccagaccaaaatccagtacgtgattagagctcagctgcacgttggagccaagcaagagaactggaacacagatatcaaaacgctgaagttcgacgccctctccggcagccaggaggctgaatttaccggctacgggaaagccacactggagtgtcaggtgcagaccgcggtcgatttcggaaattcctatatcgctgaaatggagaaggactcttggattgtggatcgccaatgggcccaggaccttacactgccctggcagagcggctccgggggaatctggcgggaaatgcaccatctcgtcgagtttgagcctccccacgccgctaccattagagtgctggcccttggcaaccaagaagggagcctgaagacggctctcacaggcgccatgcgcgttaccaaagatgagaatgacaacaatctgtacaagctgcatggaggccacgtgtcttgccgggtcaaactctccgcgctgacccttaaggggacaagctataaaatgtgtaccgataagatgtctttcgtgaagaacccgacagacacgggacacggcaccgttgtgatgcaggtcaaagtgcctaagggggccccctgcaaaatccctgtgattgttgctgacgatctgacagccgctgtcaataagggaatcctcgtgaccgtgaaccccatcgccagcacaaatgacgatgaagtcctgattgaggtgaatcccccttttggcgactcctacatcattgttgggaccggcgattctagactgacgtatcagtggcataaagaaggaagctccatcggcaaacttttcacccagacaatgaagggggcggagcgcctcgccgtgatgggagacgctgcctgggatttcagctctgctggcgggtttttcacctccgtcggaaagggcattcacacagtgtttgggagcgccttccaaggcctgtttggaggcctgtcttggatcaccaaggttatcatgggggccgtgctcatttgggtcggaatcaacacgcggaacatgacaatgtccatgagcatgattctggtgggcgttatcatgatgttcctttccctgggggtgggagctgaccagggctgtgcggtcaattttgggaaa

SEQ ID NO: 862 - RNA, 2091 nt, synthetic construct
  misc_feature 1..2091: note = derived and/or modified CDS sequence (opt5) from YFV__AY968065__X-SS-prME-XX
  source 1..2091: mol_type = other RNA
atgagaggcctgagctcccggaagcgcagatctagcgagatgaccatgatgcccctcctgatcctttccatggtgattctgggaggaggcgtcacactcgttcggaaaaaccgctggctgcttctgaatgtgacggccgaagacctcgggaagaccttctctgtgggaacaggcaactgcaccacaaatatcctggaggctaaatactggtgtcctgatagcatggaatataactgcccgaatctgtcccccagagaggaacctgacgatattgactgttggtgctacggggtcgagaacgtgcgggttgcctatggacgctgtgatgcggtgggcagatctaagcggagccgcagagctatcgacctccccacccacgagaatcatggcctgaaaacacggcaggaaaagtggatgaccgggcgcatgggagagagacaacttcagaagattgaacggtggctggtccgcaaccctttcttcgccgtgacggccctcgctatcgcctacctggttggcaataacaaaacccagagagtggtcatcgcccttctggtgctcgctgtggggcccgcgtattccgcccactgcattggaatcacagatcgggactttattgagggcgtccatgggggaacctgggttagcgcttctctggagcaggataagtgtgtgacagtgatggcccctgacaaaccgtccctggatatcagcctccaaaccgtcgctattgacggccccgccgaagcgagaaaggtgtgctactctgccgttctgacgcacgtgaaaatcaatgataagtgtccttccacaggcgaggctcatcttgccgaagagaacgacggggacaatgcttgcaagcgcacctatagcgatcggggatggggcaacgggtgtggactgttcggcaaagggtctattgtcgcctgcgccaagtttacatgcgctaaatccatgagcctcttcgaagtggaccagaccaagatccagtacgttatcagagcgcagctgcacgtgggagccaaacaagagaattggaacaccgatattaagacacttaaatttgacgctctgtccggctctcaggaggccgaatttacgggctacgggaaggccaccctcgagtgtcaggtccagacagctgtggattttggaaacagctatatcgccgaaatggagaaggactcctggattgtcgatcgccaatgggcgcaggacctgaccctgccctggcagagcggctctgggggaatctggcgggaaatgcaccatctcgtggagttcgagcctccccacgctgccacaattagagttctggcccttggcaatcaagaagggtccctgaaaaccgctctcacgggcgccatgcgcgtgacaaaggatgagaacgacaataacctgtacaaacttcatggaggccacgtcagctgccgggtgaagctgtctgctctcaccctgaaagggaccagctataagatgtgtacagataagatgtcctttgttaaaaatccgaccgacacaggacacggcacggtggtcatgcaagtgaaggtgcctaaaggggccccctgcaagatccctgttatcgtcgcggacgatctgaccgccgctgtgaacaaagggattctcgtgacagtcaatcccatcgcctctaccaacgacgatgaagtgctgattgaggttaatccccctttcggcgacagctacatcattgtggggacaggcgattccagacttacctatcagtggcataaggaaggaagctctatcggcaagctgtttacgcagaccatgaaaggggtcgagcgcctcgctgtgatgggagacgccgcgtgggatttctccagcgccggcgggttctttacatctgttggaaagggcatccacaccgtgttcgggtccgcttttcagggcctgttcggaggcctgagctggattacaaaagtcatcatgggggccgtgcttatttgggttggaatcaacacccggaatatgacgatgtccatgtctatgattctcgtgggcgtcatcatgatgtttctgagcctgggggtgggagctgaccagggctgtgccgtgaacttcgggaag

SEQ ID NO: 863 - RNA, 2061 nt, synthetic construct
  misc_feature 1..2061: note = derived and/or modified CDS sequence (opt6) from YFV__L06480__X-SS-prME-XX
  source 1..2061: mol_type = other RNA
atgagaggactcagcagtagaaaaagaagatcacatgatgtattaacagtacaatttctcatacttggaatgttattaatgacaggaggtgtaactttagtccgcaaaaaccgatggttactactaaatgtaacaagtgaagacttaggtaaaacattctccgtaggtacaggaaattgtacaactaatatattagaagcaaaatactggtgtccagactcaatggaatacaattgtccaaatctatcaccacgagaggaaccagatgatatagactgttggtgctacggagtagaaaacgttagagtggcatatggcaaatgtgacagtgcaggacgaagcagaagatcacgtagggctatagatctacctacacatgaaaatcacggattgaaaacacgtcaagaaaaatggatgacaggacgtatgggagagcgacaattacagaaaatcgaaagatggtttgtacgaaatcctttctttgctgtaaccgcactaacaatagcctacctagtaggatcgaatatgacacaaagagttgtaattgccttattagttctagctgtaggaccagcatattcagcacactgtataggaataacagatagggattttattgagggtgttcatggaggaacatgggtaagcgcaacattagaacaagataaatgtgttactgtaatggcacctgataaaccaagtttagatattagtttggaaacagtagcaatagatagaccagcagaagcaagaaaagtatgctacaatgcagtactaacacatgttaaaataaacgacaaatgcccgtcaacgggtgaagcacacttagctgaagaaaatgagggagataacgcttgtaaaagaacttacagtgatagaggttggggaaatggatgtggattatttggaaaaggaagtatagtagcatgtgcaaaattcacttgtgcaaaatctatgagcttatttgaagtcgatcaaacaaaaatacaatatgtaatacgagcacaattacacgtaggagcaaaacaagaaaactggaacacatcaataaaaactctaaaatttgatgctctttcaggttcgcaagaggtagaatttataggatatggcaaagctacattagagtgtcaagtacaaacagcggtagattttggaaattcatatatagcagaaatggaaaccgaaagttggatagtagatagacaatgggctcaggacctaacgttaccatggcaatcgggaagtggaggagtctggagagaaatgcatcacctagtagagttcgaaccaccgcatgcggcaacaatccgagttctagccctgggcaatcaagaaggctcactaaaaacagcactaacaggagctatgagggttacaaaagacactaatgataacaatttatataaattacatggaggacatgtaagttgcagagtgaaattatcggcgctaacactaaaaggaacatcatataaaatctgcacagacaaaatgttcttcgttaaaaatccaacagatacaggacatggtacggtagtgatgcaagttaaagtaccaaaaggagcaccgtgccgaataccagttatagtagcagatgatttaacagcagcaattaataaagggattctagttacagtcaatccaatagcttcaacaaatgatgatgaagtactcatagaagttaatccaccattcggcgacagctatataatagtaggaagaggagatagtcgattaacatatcaatggcataaagaaggaagtagtatcggtaaactatttacacaaactatgaaaggtgtagaaagattagctgtaatgggagatgtcgcgtgggacttttcgagcgcaggcggcttctttacaagcgtaggaaaaggcatccatacagtatttggaagtgcatttcaaggattatttggaggattaaattggataacaaaagttataatgggagcagtactaatatgggttggtataaatacaagaaacatgacgatgagtatgtccatgatattagttggagtaataatgatgttcttatcattaggtgtaggagca

SEQ ID NO: 864 - RNA, 2091 nt, synthetic construct
  misc_feature 1..2091: note = derived and/or modified CDS sequence (opt6) from YFV__D14458__X-SS-prME-XX
  source 1..2091: mol_type = other RNA
atgcgtggattaagctctcgaaaaagaagaagttatgaagtactgacagtacaattcctaatcctgggaatgctattaatgactggtggagtaactttggtaaggaaatcaagatggctattattaaatgtaacaagtgaagatttaggtaaaacattttcagtaggaacaggaaattgtaccacgaatattttagaagccaaaaattggtgcccagattcaatggaatataattgcccaaatttaagtcctagagaagaaccagatgatatagactgttggtgctatggagtcgagaatgtacgagtagcgtatggaaaatgtgattcagcaggaagaagtcgacgttctaggagagctatagatcttccgacacatgagaatcatggactaaagacaagacaagaaaaatggatgacaggaagaatgggagaaagacaacttcagaaaattgaacgatggttagtaagaaatccattctttgcggtaacagcactagcaattgcatacttagtaggatctaatatgacacaaagagtagtaattgcacttctcgtacttgccgtcggccctgcgtactcagcgcattgcatcggaattactgatagagattttatagaaggagtacatggcggaacatgggtgtcagctacattagaacaagataaatgcgttacggtaatggcgccagacaaacctagccttgacataagtttagagactgtagcaattgacggaccagcggaagcacgaaaagtatgttactctgcagtattaactcatgttaaaatcaatgataaatgtccatctactggagaagcacatctggcagaagaaaacgaaggagaccacgcttgcaaacgaacatactctgacagagggtggggaaatggatgtggattattcggaaaaggaagtatagtagcatgcgcaaaatttacatgtgcaaaatcaatgagcctgtttgaagtagatcaaacgaaaatacaatatgtaattagagcacaactacatgtaggcgcaaaacaagaaaactggaatgcagacataaaaacattaaaattcgatgcattatcaggatcacaagaagcagaatttacaggatacggaaaagcaacattagaatgccaagtacaaacagcagttgacttcagcaatagttatatagcagaaatggaaaaagaaagctggatagtagatagacaatgggcccaagacttaactttgccatggcaatctggaagtggaggtgtatggagagaaatgcatcacttagtagaatttgagcctccacatgctgccaccataaaagtattagcgttaggcaaccaagaaggatcattaaaaacagctctaacaggcgcaatgagagtaacgaaagatactaatggatctaatctatataaattacatggcgggcatgttagttgcagagtaaaattaagtgctctaacattaaaaggtacatcatacaagatgtgtacagataaaatgagctttgttaaaaatccgactgatacaggccatggtacagcagtaatgcaagtaaaagtaccaaaaggtgcaccatgtaggattccggttatggtagcagatgacttaacagcaagcgtaaataaaggaatcttagtcacagtaaatccaattgcaagtacgaacgaggacgaagttttaatagaagtaaatccgccttttggcgatagctatataatagtaggaacaggagattcaagattaacatatcaatggcataaagaaggttcaagcataggcaaactatttacgcaaacaatgaaaggagctgaaagactagcagtaatgggagatgcggcatgggatttctcatcagcaggaggattctttacatcagtaggcaaaggtatacatatggtatttggatctgcgtttcaaggactatttggaggattatcatggataacaaaagtaataatgggtgcagttctgatatgggtaggaataaatatgagaaacatgacaatgtcgatgagcatgattctagtaggagtaatcatgatgtttttaagtttaggggtaggagcagatcaaggatgcgcaataaattttggaaaa

SEQ ID NO: 865 - RNA, 2091 nt, synthetic construct
  misc_feature 1..2091: note = derived and/or modified CDS sequence (opt6) from YFV__U21055__X-SS-prME-XX
  source 1..2091: mol_type = other RNA
atgagaggattaagcagcagaaaaagaagaagtcacgatgtacttacagtacaatttctaattttaggaatgctgctaatgacaggaggtgtaaccttagtaaggaaaaacagatggttattattaaatgtaacaagcgaagatctaggaaaaacttttagtatgggaactggaaactgtacaacaaacatattggaagcgaagtattggtgtccagactcaatggaatacaattgcccaaatttgagccctagagaagaacctgatgatatagattgctggtgttatggtgttgaaaacgttagagtagcatacggaaaatgtgattctgccggaagatcaagaagatcccgaagggcaatagacctacctacacatgaaaatcacggtctaaaaacacgacaagaaaaatggatgacaggaagaatgggagaaaggcaactccagaaaattgagagatggtttgtaagaaatccattcttcgctgtgactgcgttaacaatcgcatatttagtaggcagtaatatgacacaacgagtagtaatagcactactggtattagcagtaggaccagcatattcagcccattgcataggaataactgaccgagactttatagaaggagtacacggaggaacttgggttagcgcaacattggaacaagataagtgtgttacagtaatggcccctgataaaccatcattagacatttctctagaaacagtagcaatagatgggccagtagaagcaagaaaagtatgctataatgcagtattaactcatgttaaaataaatgataaatgtccctcaacaggagaagctcatttagcagaagaaaatgaaggcgacaatgcatgtaaaagaacatattctgatagagggtggggtaacggatgcggattattcggaaaaggctcaatagtagcttgcgcaaagttcacttgtgcaaagtccatgagcctatttgaagtagatcaaacaaagattcaatacgttataagggccagacttcacgtaggagcaaaacaagaaaattggaaaacagacataaaaacccttaaattcgatgcactatcgggttcacaagaagcagagttcacaggatatggaaaagcaacattagaatgccaagtgcaaacagctgttgattttggtaactcatatatagcagaaatggaaaaagaaagttggatagtagacagacaatgggcacaagatctaactttaccatggcaatcaggttcaggaggtgtatggagagaaatgcaccatctagtagaatttgaacccccacatgcagccacaatacgagtattagccctaggagatcaagaaggatccctaaaaactgctttaacaggagctatgagagtaacgaaagacacaaacgataataatttatacaaattacatggcggacatgtaagttgcagagttaaattatcagcactaacacttaaaggcacaagctataaaatgtgtacggataaaatgtcatttgttaaaaatcctacagacacgggccatggaactgtagtaatgcaagtaaaagtaccaaaaggagccccatgtaggataccagtaattgtagcggatgatttaactgcagcaatcaataaaggaattttagtaacagttaacccaatagcatcaacaaatgatgacgaagtattaattgaagttaatccaccgtttggagatagttatataatagtaggaactggagatagtcgattaacatatcaatggcataaagaaggaagctcaataggaaaactgttcacacaaacaatgaaaggagcagaaagattagcagtaatgggtgacgcagcttgggattttagtagcgctggtggattctttacaagtgtcgggaaaggaatacacacagttttcggatcagcattccaaggtttattcggaggactaaactggataacaaaagtaataataggcgccgtgttaatatgggtaggaataaatacaagaaatatgacaatgagcatgagcatgatattagtaggagttataatgatgttcctatcactaggagtaggtgcagatcaaggatgtgcaataaattttgcaaaa

SEQ ID NO: 866 - RNA, 2091 nt, synthetic construct
  misc_feature 1..2091: note = derived and/or modified CDS sequence (opt6) from YFV__U21056__X-SS-prME-XX
  source 1..2091: mol_type = other RNA
atgagaggactaagctctcgaaagaggagatcacatgatgtattaacagtacaatttttgatactagggatgttactcatgacaggaggtgtaactttagtcaggaaaaacagatggttattgctaaatgttacaagtgaagacttaggaaaaacattcagtgtaggtacaggaaattgtactacaaatatattagaggcaaaatattggtgtccagattcaatggaatataattgtcctaatttatccccaagagaagaaccagatgatattgactgttggtgttatggggtagaaaacgtaagagtagcatacggaaaatgtgactcagcaggtagaagcagaaggtcgaggagagcaattgatttaccaactcatgaaaatcatggactaaaaacacgtcaagaaaaatggatgacaggcagaatgggtgaaagacaactacaaaagatagaaagatggttagttcgaaacccattctttgccgtaacagcgctgacaatagcatacttagtcggatctaatatgactcaaagagtagtaattgcactattagtactagcagttggaccggcatattcagcacactgtataggaataacagacagagattttatagaaggagtgcacggtggaacatgggtgtcagcaacgttagaacaagataaatgcgttactgttatggcaccagataaaccatccctagacatatctttagaaacagtagcaatcgatgggcctgctgaagctaggaaagtatgttacaacgcagtgttgacacatgtgaaaataaatgataaatgtccctcaacaggtgaagctcatctagcagaagaaaacgaaggagacaatgcctgtaaaaggacttattcagatagaggttggggaaatggatgtggactatttggaaaaggttcaatagttgcttgtgcaaaatttacctgcgctaaaagtatgagtctatttgaagtagatcaaactaaaatacaatacgttataagagcacaattacatgtaggtgcaaaacaagaaaattggaatacagatattaaaacattaaaatttgatgctttgtctggaagtcaagaagcagaatttacaggatacggaaaagcaacgctagaatgtcaagttcaaacagcggtggatttcggaaacagctacatagcagaaatggaaaaagaaagctggattgtagatagacaatgggcacaagatctaacactaccatggcaatcaggatcgggtggtgtatggagaggtatgcatcatttagtagaatttgaaccacctcatgcagcaacaatcagagtgttagcattaggaaaccaagaaggttctctaaaaacagcactaacaggagcgatgagagtcactaaagatactaatgataacaatttatataaattacatggaggtcatgttagttgtagggtaaaattatcagcattaacactaaaaggaacaagttacaaaatgtgtacagataagatgagtttcgttaaaaatccaacagatacaggacacggaacagtagtaatgcaagtaaaagtaccaaaaggagcaccctgtagaataccagttattgtagctgatgacttaacagctgcaataaacaaaggtatattagtcacagtaaacccaatagcatcaacaaacgatgacgaagtactaatagaagtaaatccaccttttggcgacagttatataatagtaggtacaggagacagcagattaacgtaccaatggcataaagaaggaagttcaattggaaagttatttacacaaacaatgaaaggagttgaaagactagcagtaatgggagacgcagcatgggacttcagttctgcaggaggatttttcacttctgtaggaaaaggaatacacaccgtatttggtagtgcatttcaaggcctgtttggaggactaaattggataacaaaagtgataatgggtgcagttttaatatgggttggaataaatacaagaaacatgacaatgagtatgagcatgattctagtaggtgtaataatgatgtttttaagtctcggagtgggtgcagatcaaggttgtgcaataaacttcggaaaa

SEQ ID NO: 867 - RNA, 2091 nt, synthetic construct
  misc_feature 1..2091: note = derived and/or modified CDS sequence (opt6) from YFV__U54798__X-SS-prME-XX
  source 1..2091: mol_type = other RNA
atgagaggtctaagctcaagaaaacgacgaagccacgatgtattgactgtacaatttctaatcttgggaatgttattaatggcaggaggagtgactttagtacgaaagaacagatggctactgttaaatgtaacgtcagaagacctaggaaaaactttcagcgtaggaacaggaaattgtacaacaaatatattggaagcaaaatattggtgtcccgacagtatggaatataactgcccaaatctatcaccaagagaagaaccagacgacatagattgttggtgctacggagtagaaaatgtgagagtagcttacggaaaatgtgatagtgcgggacgatcgcgacgatctaggagagctatcgatctaccaacccatgaaaaccacggattaaaaaccagacaagaaaaatggatgactggccgaatgggagagcgccaattacaaaagatagaaagatggttagtaaggaacccattctttgcagtaacagcactagctatagcatatttagtcggatcaaatatgacgcaaagagttgtaatagcattgttagtactagccgtagggcctgcatatagtgcacactgtattggaataacggatcgagattttatagaaggagtacacggcggaacatgggttagcgccactctggaacaagacaaatgtgttacggtaatggcacccgataaaccatccttagatataagcctagaaacagttgcgattgacggaccagctgaagcaagaaaagtatgttacaacgctgtactaacacacgttaaaataaatgataaatgcccatccacgggagaagctcacttagcagaagaaaacgaaggcgataatgcatgtaaaagaacgtattcagatagaggatggggaaatggttgtggactatttggaaaaggaagtatagtggcatgtgcaaaatttacatgtgccaaatcaatgagcttatttgaagttgatcaaacaaaaatacaatatgtaataagagcacaacttcatgtaggtgcaaaacaagaaaactggaatacagacataaaaacattaaaattcgatgcattatcaggaagtcaagaagcagaatttacaggatatggaaaagctactctagaatgtagagtacaaactgcagtcgattttggaaatagttacatagcagaaatggaaaaagaaagttggatagtagacagacaatgggcacaagacttgacactaccatggcaatctggatcaggaggagtctggagagagatgcatcacttagtagagtttgaacctccacatgcagcaacaataagagtattagcattaggtaatcaagaaggttctttaaaaactgcactcacaggagcaatgagggtaacaaaagatacaaatgataataatttatataaactacacggaggacatgtatcatgtcgtgtaaaattatctgctctaacactaaaaggaacttcatataaaatgtgcacagataaaatgtcattcgtcaaaaatccaacagacacggatcacggaacagtagtaatgcaagtgaaagtaccaaaaggagcaccatgtaaaataccagtaattgtagcagatgacttaacggcagcaataaataaaggaatacttgtaacagtaaacccaatagcatcgacaaatgacgatgaagttttaattgaagtaaacccaccattcggagacagttatataatagtcggaacaggagactcaagattaacctatcaatggcacaaagagggaagcagtatcggaaaattatttacacaaacaatgaaaggagcagaaaggttagcagtaatgggagacgcagcatgggatttctcaagcgcaggaggactatttacaagtataggaaaaggatcacacacagtattcggatcagcttttcaaggcttatttggtggtctctcatggataacaaaagtaataatgggagccgtattaatatgggtaggaataaatactagaaacatgactatgtccatgagtatgattttagtcggggttataatgatgtttttatctttaggagttggagcggatcaaggatgcgctataaacttcggtaag

SEQ ID NO: 868 - RNA, 2061 nt, synthetic construct
  misc_feature 1..2061: note = derived and/or modified CDS sequence (opt6) from YFV__AF052440__X-SS-prME-XX
  source 1..2061: mol_type = other RNA
atgagaggattaagttcaagaaaaagaagatcgcacgacgtactaacagttcaatttctaattttaggtatgttactaatgacaggtggagtaactttggtaagaaagaacagatggttactactaaatgtaacaagcgaagacttaggaaaaactttcagtgtaggaacaggaaattgcactacaaacatcttggaagcaaaatattggtgtcctgattctatggagtataattgtcccaatctttcaccacgagaagaaccagacgatattgattgctggtgttacggtgtagaaaacgtacgagtggcttatggaaaatgtgacagcgctggaaggagcagaagatcacgcagagctatagatctacctactcatgaaaatcatggcttaaaaactagacaagaaaaatggatgacaggacgaatgggagaaagacaactacagaaaatagaacgatggtttgtaagaaatccattctttgcagttacagcactaacaatcgcatatctagttggaagtaatatgacacaaagagttgttattgctctattagtcttagctgtaggcccggcatattctgcacattgcataggaataacagatagagattttatagaaggagtacacggtggaacgtgggttagcgcaacattagaacaagataaatgtgtaacagtaatggctccagacaaaccaagtctagacatttcactagaaacagttgcaatcgatagacctgctgaagtaagaaaagtttgttataacgctgtgttaacacatgtaaaaattaatgataaatgtccatcaacaggtgaagcacatcttgcagaagaaaacgaaggagataatgcatgtaaaagaacttattccgatagaggatggggaaatggttgtgggttattcggaaaaggatcaatagttgcatgtgctaaattcacatgcgcaaaaagcatgtctttatttgaagtagaccaaacaaaaatacaatatgtaatcagagcacaattacatgtaggagcaaaacaagaaaattggacaactgacataaagaccctaaaattcgatgcgttatcagggtctcaagaggttgaatttataggttatggaaaggcaaccctagaatgccaagttcaaaccgcagtagatttcggaaacagttacatagcagaaatggaaactgaaagctggatcgtagacagacaatgggcccaagacctaacattaccttggcaatctggaagcggaggagtttggagagaaatgcatcatttagtagaatttgaaccaccccatgcagcaacaataagggtactagcactaggaaaccaagaaggatcactaaaaacagctttaacaggcgcaatgcgagtaacaaaagacacaaacgacaataatctgtacaaattacacggaggacacgtcagttgtagagtaaaattgagtgctctaaccttaaaaggtacctcatataaaatatgcactgataaaatgtttttcgtgaaaaatcccacagacacaggccatggaacagtagtaatgcaagtcaaagtttcgaaaggggctccatgtagaataccagtcatagttgcagacgatctaacagcagcaataaataaaggaatattagtaactgtaaatccaatagcctcaacaaatgatgatgaggttctaatagaagttaatccaccttttggagatagctatattatagtagggagaggagattcaagattaacatatcaatggcataaggaaggatcatcaattggaaaactattcacacaaacaatgaaaggtgtcgaaagattagcagtaatgggagatacagcatgggatttttcaagtgcgggagggttctttacgagtgtcggaaaaggaatacacacggtatttggatcagcatttcaaggactattcggtggattaaattggataactaaagtaattatgggcgcagtattaatatgggttggtattaatacaagaaatatgacaatgtccatgtcaatgattttagtaggcgtaataatgatgtttttaagtttaggagtaggcgca

SEQ ID NO: 869 - RNA, 2091 nt, synthetic construct
  misc_feature 1..2091: note = derived and/or modified CDS sequence (opt6) from YFV__AF052445__X-SS-prME-XX
  source 1..2091: mol_type = other RNA
atgaggggtttgagtagtagaaaacgaaggtcacatgacgtattaacggttcaatttttaatattagggatgctattaatgacaggaggtgttactttagtaaggaaaaatagatggttattattaaatgttacttcagaagacctaggaaagacattctctgtaggtacaggaaattgtacaacaaatatattggaagcgaaatattggtgcccagactcaatggaatataattgcccaaatcttagtccaagagaagaacccgatgacatagactgctggtgttatggagtagaaaatgttagagtagcatatggaaaatgcgatagtgcaggtagatcaagaagaagcaggagagcaattgacctaccaacacatgaaaatcatggtttaaagacgagacaggaaaaatggatgacaggcagaatgggcgaaagacaactacagaaaatagaaagatggtttgtaagaaacccattctttgctgtaacagcattaactatagcctatctagtaggaagtaatatgacacaaagagtcgtgatagcactcttagtattagctgttggccctgcatattcagcacattgtatcggaatcacagatagagatttcatagaaggagtacatggaggaacctgggtgtctgcaacgttagaacaagataagtgtgtaacagtaatggctcctgataaacctagcttagatatatctttagaaacagtagcaatagatagaccagctgaagtaagaaaagtctgctacaacgcagttttaacccacgttaaaataaatgataaatgcccaagtactggagaagctcatctagcggaagaaaacgaaggagacaacgcatgtaaacgtacatatagtgatagaggatggggcaatggttgtggactatttggaaaaggaagtatagtcgcgtgtgcaaaatttacctgtgctaaaagtatgtcactatttgaagtagatcaaactaaaatacaatatgtgataagagctcaattacatgtaggtgcaaaacaagaaaattggaacacagacattaaaaccttaaaatttgatgctctaagtggtagccaagaagttgaatttataggatatggaaaagcaacactagaatgtcaagtacaaactgcagtagacttcggaaattcatatattgcagaaatggaaacagaatcatggatagtagatagacaatgggcgcaagatttaacattaccatggcaaagcggatctggtggagtgtggagagaaatgcatcatttagttgaatttgaaccaccacatgcggcaacaataagggtattagcattaggaaaccaagaaggttcactaaaaacagcacttacaggagcaatgcgagtaacaaaagatacaaacgacaataacctatataaactacatggaggacacgtaagttgtcgcgtgaaattaagcgcacttactcttaaaggtacatcttataagatatgtacagacaaaatgttctttgtcaaaaatccaacagacactggtcatggtacagtagtaatgcaagtaaaagtatcaaaaggagcaccatgccgaatacccgtaatagtagcagatgacttaacagcagcaattaataaaggtattctagtaacagtaaatccaattgcaagtacgaacgacgacgaagtacttatagaagtaaatcctccttttggagattcttatattattgtaggacgtggagactcgagattaacatatcaatggcacaaagaaggaagcagcataggaaagttattcacacaaactatgaaaggagtagaacgattagcagtaatgggcgacacagcatgggatttttcatcagcaggagggttctttaccagcgtagggaagggaatacatacggtatttggaagtgcgtttcaaggcttatttgggggattaaattggataacaaaagtaataatgggagtggtactaatatgggtaggaataaacacaagaaacatgacaatgagtatgagcatgataatggtgggtgttataatgatgtttctatcattgggtgtaggggcagatcaaggatgcgcaataaattttggaaaa

SEQ ID NO: 870 - RNA, 2091 nt, synthetic construct
  misc_feature 1..2091: note = derived and/or modified CDS sequence (opt6) from YFV__AF094612__X-SS-prME-XX
  source 1..2091: mol_type = other RNA
atgaggggactgtcatcaagaaaaagaagatcacatgacgttctaacagttcaatttctaatactaggaatgttactaatgacaggaggagtaacattaatgagaaagaatagatggctactcctaaacgttacaagcgaagatttaggaaaaacattcagtataggaacaggaaattgcacaacaaatatattagaagcgaaatattggtgtcccgatagtatggagtataattgcccaaaccttagcccaagagaagaaccagatgatatagattgttggtgctatggagtagaaaatgtaagagtaacatatggcaaatgtgatagtgcaggcagaagtagaagatcgaggagagctatagatttacctacgcatgaaaatcacggattaaaaacaagacaagaaaaatggatgactggacgaatgggagaaagacaattacagaaaatagaaagatggtttgttagaaatccattctttgccgtaacggccctaactatagcatacttagtaggaagtaatatgacacaaagagttgtaatagcattattagtactagcagtaggaccagcatacagtgcacactgtataggggttgcagacagagattttatagaaggagtacacggaggtacatgggtaagtgcaacattagaacaggataaatgtgtaacagtaatggcaccagataaacctagcctagacataagcctagaaacggtagcgatagatggtccagttgaggcaaggaaagtatgttataacgcggtgttgacacatgtgaaaatagatgataaatgtccaagcactggagaagcccatctagcagaagaaaatgagggagataatgcttgtaaaagaacatactctgacagaggttggggaaatggatgtggtttatttggaaaaggttctattgtagcatgtgcaaaatttacatgcgcaaaaagtatgtcactatttgaagttgaccagacaaaaatccaatacgtaataaaagcacaactacatgtgggtgcaaaacaagaagactggaaaacagatataaaaacattgaaatttgatgtgctttcaggatcacaagaggctgaatttacaggttatggaaaagtaacattagaatgtcaagtacaaactgcggtagatttcggaaactcatatatcgcagaaatggaaaaggaaagctggatagtagatagacaatgggcccaagacttaaccttaccatggcaatcaggctccggcggagtttggagagaaatgcaccatctagttgaatttgaaccaccacatgcagcaactataagagtactagctttaggcgaccaagaagggtcactgaagacggcattaacgggcgctatgagggtgacgaaagatactaatgataataacttatacaaactacatggaggacatgtaagctgtagagtaaaattatcagctctaacattaaagggtacaagctataaaatgtgtacagataagatgtcttttgtgaaaaatccaacagatacaggacatggaacagtagtaatgcaggttaaagtaccgaaaggtgcaccatgcaaaataccagtaattgtagcagatgatttaacagctgcgatcaataaagggattctagtaacagttaacccaatagcaagtacaaatgacgatgaagtattgatagaagttaatccaccattcggagatagttatataataataggaacaggagattcgagattaacttatcagtggcataaagaaggaagtagtataggaaaattatttactcaaacaatgaaaggcgcagaaaggctcgcagttatgggtgacgcggcgtgggacttttcaagtgcgggaggtttctttacatctgtagggaaagggatacacacagtatttggaagtgcgtttcaaggcttatttggaggattaaactggataacgaaagtaataatgggtgcagttttgatatgggttggatttaatacacgtaatatgacaatgagcatgtcaatgatattagttggagtaataatgatgtttctatctcttggtgttggtgcagaccaaggatgtgcaattaatttcggcaaa

SEQ ID NO: 871 - RNA, 2091 nt, synthetic construct
  misc_feature 1..2091: note = derived and/or modified CDS sequence (opt6) from YFV__KF769015__X-SS-prME-XX
  source 1..2091: mol_type = other RNA
atgagaggactatcctcaagaaaaagaaggagtcatgatgtgctgacagtgcaatttttaatattgggaatgctactaatgacgggaggtgtaacacttgtccgtaaaaatagatggttactcttaaatgtaacaagcgaagatttaggtaaaacatttagtgtagggacaggaaattgtacaacaaacatattagaagctaaatattggtgtcctgacagtatggaatataactgcccaaatttaagcccgcgagaagaaccagatgatatagattgttggtgttatggtgtcgaaaatgttagagttgcatatggaaaatgtgatagcgctggaagaagtaggagatcaagacgagcaatagacttaccaacacacgaaaatcatggattaaaaactagacaagaaaaatggatgacaggaagaatgggagaaagacaattacagaaaatagaaagatggtttgtcagaaacccatttttcgctgttacagcacttacaatagcatatttagtaggatcaaacatgacacaaagagtagtaatagcactattagtactagcagtaggaccagcgtacagtgctcattgtataggaataaccgatagagattttatagaaggagtacatggaggaacttgggtaagcgcaacgctggaacaagataaatgtgtaacggtaatggcaccggataaaccaagtttagatataagccttgaaacagtcgcaatagatagaccggccgaagtgagaaaagtatgttataatgcagtactaacacatgtaaaaataaatgataaatgccctagtacaggagaagcgcatttagcagaagagaatgaaggagataatgcatgcaaaagaacttattcggatagaggatggggaaatggatgtggattatttggaaagggaagtatagtagcatgtgctaaattcacatgtgctaaatcaatgtcattattcgaagtagaccaaacaaaaatacaatatgtaataagagcacaactacatgtaggagctaaacaagaaaactggacaacagatataaaaacattgaaatttgatgcattatctggatcacaagaagtagaatttattggatacggaaaagcgacactagagtgtcaagtacaaacagcagttgatttcggaaattcatatattgctgagatggagacagaaagttggatcgtggacagacaatgggcacaagatctaacactaccatggcagtcaggtagtggaggtgtatggagagaaatgcatcatctagttgaatttgaaccaccacatgcggcaacgataagagtattagctttaggaaatcaggaaggaagcctaaaaacagcactaaccggagcaatgagggtaacaaaagatacaaatgataataatttatataaattgcatggaggacacgttagttgcagagtaaaattatctgcactaacattgaagggaacatcatataaaatttgcactgataagatgttctttgttaaaaatccaacagatacaggacacggaacagtagtaatgcaagtaaaagtatcaaagggagcaccttgcagaataccggtaatagttgctgacgacctaacagctgcaataaataagggaatacttgttacagtaaatccgatagcaagtacaaatgacgacgaagtattaatagaagttaatccaccatttggggatagttatataatagtaggaagaggtgatagtagattaacgtaccaatggcataaagaaggaagcagcataggaaaattattcacccaaacaatgaaaggagttgaaaggttagcagtaatgggtgataccgcatgggacttttcgtctgctggaggattctttacaagcgttggaaaaggtatacacacggtttttggaagtgcattccaaggactcttcggaggacttaattggataacgaaggtaataatgggagccgtgttaatatgggtaggaattaacaccagaaatatgacaatgagtatgagtatgattctagtaggtgtcataatgatgttcttatcattaggagtaggggcagatcaaggatgcgctataaattttggaaaa

SEQ ID NO: 872 - RNA, 2091 nt, synthetic construct
  misc_feature 1..2091: note = derived and/or modified CDS sequence (opt6) from YFV__KF769016__X-SS-prME-XX
  source 1..2091: mol_type = other RNA
atgagaggattaagttctagaaaaagacggtctcatgacgtattaacggttcaatttctaatattagggatgctactaatgactggtggcgtaacattggtaagaaagaatcgatggcttttgttaaatgtaacctcagaagatctaggtaaaacatttagtgtaggtactggaaattgtacaaccaatatactagaagcaaaatattggtgtcctgattcaatggaatataattgtccaaatttaagtccacgagaggaacccgatgatatagactgctggtgttacggagtagaaaatgtacgagtagcatacggaaaatgcgacagtgcaggaagatctagaagatcgcgcagagcaatagatctaccaactcatgagaaccatggtttaaaaacaagacaagaaaaatggatgacaggtagaatgggggaaagacaacttcagaaaatagaaagatggttggtaagaaatcccttctttgcagtaacagctctaactatagcttatttagtaggatcaaacatgacgcaaagagttgtaattgctctattagttctagcagtaggcccagcatattcagcacattgtataggtataacagatagagattttatagaaggagtacatggtgggacatgggtctctgcaacattagaacaagacaaatgtgtaacagttatggcaccagacaaaccatcactagacatatctctagaaacagtagcaattgatggaccagcagaagctagaaaagtatgctataatgctgtactaacccatgttaaaataaatgataaatgcccttcaacgggagaagcccatttagccgaagaaaatgaaggagataatgcatgcaaaagaacatattcagatagagggtggggaaacggatgtgggttatttggtaaaggaagtattgtagcatgtgcaaaatttacatgcgccaaatcaatgagcttattcgaagttgaccaaacaaaaatacaatatgttataagagcgcaattacatgtaggagcaaaacaagaaaattggaatacagacataaaaacattaaaattcgacgcattatcaggctcacaagaagcagagtttacaggatacggtaaagctactctagaatgtcaagttcaaaccgctgtagacttcggtaatagttatatagctgaaatggaaaaagagagttggatcgtagacagacaatgggcacaagacctaacattaccatggcaatcaggatcaggtggagtatggagagaaatgcatcatctggtagagttcgaaccaccacatgctgcaacaatcagggttctagccttaggaaaccaagaaggaagtttaaaaacagccttaacgggagcaatgagggtaacgaaagataccaatgataataatctatataaactacatggaggccacgtaagctgcagggtaaaattaagcgcattaacattaaaaggaacatcatacaaaatgtgtacagataaaatgtctttcgtgaaaaaccctacagacactggacatggcacagtagtaatgcaagtaaaagtacctaaaggagcaccttgtaaaataccagtaatagtagcagatgatttaacagcagcaataaataaaggaatcctagtaaccgtaaatccgatagcatcaacaaatgacgacgaagtattaatagaagtaaacccaccatttggagacagttacatcatcgtaggtacaggagactcaagattaacatatcaatggcataaagaaggatcatcaataggaaaattatttacacaaacgatgaaaggggcagaacgactagcagtaatgggcgacgcagcatgggattttagtagtgcaggaggattctttacaagtgtcggaaaagggatacatactgtatttggctcggcatttcaaggattatttggtggactaaactggataacaaaagtaattatgggagctgtattgatatgggttggaatcaatacacgtaacatgacaatgagtatgtcaatgatattagtaggagttataatgatgtttttatcactaggagtaggtgcagatcaaggatgtgccataaatttcggaaaa

SEQ ID NO: 873 - RNA, 2091 nt, synthetic construct
  misc_feature 1..2091: note = derived and/or modified CDS sequence (opt6) from YFV__KF907504__X-SS-prME-XX
  source 1..2091: mol_type = other RNA
atgagaggcctatcaagcaggaaaagaagatcgcatgaagtactaacggttcaatttttaatattaggaatgcttttaatgacaggaggagtgacattagtaaggaaatccagatggttactacttaatgtaacaagtgaagatttagggaaaactttcagcgtaggaacaggtaattgtacaacaaacattttagaagctaaaaattggtgtccagacagtatggaatataattgtccaaatttaagtccgagagaagaaccagatgacattgattgttggtgctatggagtcgaaaatgtaagagttgcatacggtaaatgtgattcagccggaagatcccgaagaagtaggagagcaatagatttaccgacacatgaaaatcacggattaaaaacaagacaagaaaaatggatgacaggtagaatgggagaaagacagttacagaaaatagaaagatggttagtcagaaacccatttttcgcggtaaccgctcttgctattgcatacctagtaggaagtaatatgacacaaagggttgtaatagcactattagtattagcagtaggaccagcatacagcgcacattgtataggtataacagatcgagactttatagaaggtgtacacgggggaacatgggtatcagctactttagaacaggataaatgtgtaacagtaatggcaccagataaaccaagtctagatatatcactcgaaacagtagcaattgatggtccagcagaagcaagaaaagtttgttatagcgcagtactaacacacgtaaaaataaatgataaatgtccaagcacaggagaagctcatctagcagaagaaaatgaaggagatcacgcatgtaaaagaacatacagtgataggggatgggggaatggatgcggactatttggaaaaggtagtatagtggcatgtgcgaaatttacttgtgccaagagtatgagtctatttgaggtggatcaaactaaaatacaatatgtgattcgagctcaactacacgtgggagcgaaacaagaaaattggaatgcagatataaaaactttaaaattcgatgcgttatcaggaagtcaagaagcagagttcactggatatggaaaagcaacattagaatgtcaagtacaaacagcagtagactttagcaattcatatatagctgaaatggaaaaggaatcatggatagtagacagacaatgggcgcaggatctaacacttccgtggcaaagtggaagtggaggagtatggcgagaaatgcatcatttggtagaatttgaaccaccacacgcagcaacaataaaagtattagccttgggaaatcaagaaggatcattgaaaacagcattgacaggggcaatgagagtcactaaagatacaaacggttcaaatctatataaattacatggaggacatgtgtcgtgtagagtaaaattaagtgcattaacattaaaaggaacaagctacaaaatgtgtacagataaaatgagctttgttaaaaacccaacagatacaggacacggaacagcagttatgcaagtaaaagtaccaaaaggagcaccatgtagaatcccagtaatggttgcagatgatttaacagcaagcgtgaataaaggaatattagtaacagtaaacccaatagcatcaacgaatgaagatgaagtattaatagaagtaaatccaccatttggagatagctacattatagtaggaactggagatagtagactaacctatcaatggcataaagaagggagtagtataggcaagttatttacacagactatgaaaggagcagaaagacttgctgtcatgggtgatgctgcgtgggacttttcgtcagcaggagggttctttacatcagttggaaaagggattcatatggtgttcgggtcggcttttcaagggctattcggagggttgagctggataacaaaagtaatcatgggagcagtccttatatgggtcggtataaatatgaggaacatgacaatgagtatgagtatgatattagtaggggtaataatgatgtttttaagcctaggtgttggagcagatcaaggatgtgctataaatttcggaaga

SEQ ID NO: 874 - RNA, 2091 nt, synthetic construct
  misc_feature 1..2091: note = derived and/or modified CDS sequence (opt6) from YFV__JF912179__X-SS-prME-XX
  source 1..2091: mol_type = other RNA
atgagaggattgtcaagtagaaagagaagatcacaagatgcattaacggttcaatttttaatattaggaatgttattgatggtaggaggagtaacattagtaagaagaaacagatggttacttttaaatgtaacatcagaagatttaggaaaaacatttagtgtcggaactggcaattgtacaacaaatatattagaagcaaaatattggtgcccagattcgatggaatacaattgtcctaacttaagtccacgggaggaaccagatgacattgattgctggtgttatggagttgaaaatgttagagtagcatatgggaaatgcgacagcgcaggacgaagtagaagaagtaggagagcaatagacttaccaacacacgagaatcatggattaaaaacacgacaagaaaaatggatgacaggtcggatgggggaaagacaattacagaaaatagaacgatggttagtaagaaatccattctttgcagctaccgccttagcaatagcttaccttgtaggtagtaacatgactcaaagagtagtcatagcattattagtactagcagtaggaccagcatattccgctcactgtattggaataacagatagagattttatcgaaggggttcatggagggacttgggtatcagctacattagaacaagataaatgtgtaacagtaatggcgccggataaacctagtttagacataagcctagaaacagtagcaatagatggtcccgccgaagcgaggaaagtttgttattctgcagtcctaacaaatgtcaagataaatgacaaatgcccatcaactggagaagcacatctggaggaggaaaacgaaggagacaatgcatgtaaaaggacatattcagatagaggatggggaaatggatgtggtttatttggaaaaggatcaattgtagcttgtgcaaaatttacttgtgcaaaaagcatgagtttatttgaggttgatcaaacaaaaatacaatatgtaataagagcacaattacacgtgggcgcaaaacaagaaaattggaatactgatataaaaactttaaaatttgatgctctatcaggaagtcaagaagcagagtttactggatacggaaaagcaacattggaatgccaagtccaaacagcggtagatttttctaatagttatatagcagaaatggaaaaagaaagttggatagtagataaacaatgggctcaagacttgacgttaccatggcaatcaggaagtggtggagtgtggcgagaaatgcatcatcttgtagaatttgaacccccacatgcagcaacaataaaagtattggctcttggaaaccaagaaggatcattaaaaacagcactgacaggagctatgcgagtaacgaaagatactaacaactctaaactttacaaactacatggaggacacgtagcatgtagagtgaaattaagtgccctaactctaaaaggaacatcatataaaatgtgtaccgataaaatgtcatttgttaaaaacccaacagatacaggacatggtacagctgtaatgcaagtaaaagtacccaagggagcaccttgtaggattccagtcatggtagcagatgacctaactgctgcggtaaataaaggaatattggtaacagtaaacccaatagcatcaacaaacgatgatgaagtattaatagaagtaaatccgccattcggtgacagttatataatcgtaggaacaggagattcaagactaacataccaatggcataaagaaggttctagcattggaaaattatttacacaaacaatgaaaggcgcagaaagactagcagtaatgggagacgcagcatgggattttggaagcgctggaggatttttcacaagtgtcggaaaaggaatccacacagtattcggaagtgcatttcagggtttatttggagggttaagttggataacaaaggtaataatgggagtagtcttaatctgggtaggcataaacactagaaatatgacaatgagtatgtcaatgatcctagtcggagtaataatgatgttcctaagtctaggcgtaggagcagatcaaggttgtgctataaattttagtaaa

SEQ ID NO: 875 - RNA, 2091 nt, synthetic construct
  misc_feature 1..2091: note = derived and/or modified CDS sequence (opt6) from YFV__JF912180__X-SS-prME-XX
  source 1..2091: mol_type = other RNA
atgagaggtttaagttcgagaaaaagaagaagtcaagatgtactaacggtacaatttctaatattaggaatgctattaatggtgggcggagtaacattagtaagaagaaatagatggcttcttttaaatgtaacttcagaagacctaggaaaaaccttctcagttggaacaggcaattgcacgacaaatatactcgaagcaaagtattggtgtccggattcaatggaatataattgtccaaacctatcacctagagaagaacccgatgatatagattgctggtgttacggagtggaaaacgttagagtagcgtatggaaaatgtgatagcgccggaaggtcaagaagatcaagacgagccattgatctacctactcatgaaaatcacggcttaaaaacaagacaagaaaaatggatgacaggaaggatgggggaaagacaattacagaaaatagaaagatggttagttagaaatcctttctttgcagcaacggctttagcaatagcgtacctagttggatcgaatatgacgcaaagagttgtaatcgctttattagtactagcagtaggaccagcatatagcgcacattgtataggaattactgatagagattttatagagggagtacacggtggaacatgggtaagtgcaacactagaacaagacaaatgtgtgacagtaatggcaccggacaaaccttcactagatattagcttagaaacggtagcaatagacggacctgcagaagctaggaaagtatgctattctgcagtactgacaaatgtaaaaataaatgataaatgtccaagcactggagaagcacacttagaagaagaaaatgaaggggataatgcatgtaaaagaacatactctgatagaggatggggaaacggatgtggattatttggtaaaggatcaatagttgcatgtgcaaaatttacatgtgcaaagtcaatgtcattatttgaagtagatcaaacgaaaatacaatacgttataagagctcaattacacgtaggagctaaacaagaaaattggaatacagatattaaaacattgaaatttgatgctctaagcggaagtcaagaagctgaatttacaggttacggcaaagcaacattagaatgtcaagtacaaacagcagtagatttctcaaattcttacatagcagaaatggaaaaagaatcatggatagttgataaacagtgggcacaggatttaactctcccttggcaatcaggatcaggaggagtttggagagagatgcatcatctagtagaatttgagccaccacatgctgctacaattaaagtattagccttaggtaatcaagaaggctcattaaaaacagcattaacaggggcgatgagagtaaccaaggacacgaataattcgaaactatataaattacatggaggacatgtgagctgtagggtaaaattaagcgcattaacattaaaagggactagctacaaaatgtgcacagataagatgagctttgttaaaaatccaacagacactggacatggaacagcagtaatgcaagtaaaagtaccaaaaggagcaccatgtcgaatacctgtaatggttgctgatgatttaacggctgcagttaataaaggcatattggtaacagtaaatccaatcgcaagcaccaacgatgacgaagtattaattgaagtaaatccaccgtttggtgattcatatataatagtaggaaccggcgactcaagactaacttaccaatggcacaaagaaggatcaagtataggaaaactttttactcaaacaatgaaaggggcggaaagactagctgttatgggagatgcagcatgggactttggatcagcaggaggattcttcacaagtgtaggaaaaggaatacatacagtatttggaagtgcctttcaaggtctatttggaggactatcatggataacaaaagtaataatgggagtcgttctaatatgggtaggaataaatacaagaaatatgacaatgagcatgtcaatgattctagtaggagtaataatgatgtttttatcactaggagtaggagcagatcaagggtgtgcaattaatttcggaaaa

SEQ ID NO: 876 - RNA, 2091 nt, synthetic construct
  misc_feature 1..2091: note = derived and/or modified CDS sequence (opt6) from YFV__JF912181__X-SS-prME-XX
  source 1..2091: mol_type = other RNA
atgcgaggacttagttcaagaaagaggagaagtcatgaagtattaacagtacattttcttatattaggaatgatgttgatgacgggaggtgtaaccctagttaggaaatcacgctggctactattaaacgtcacgagcgaagacctaggaaaaacattctcagtaggcacaggaaattgcactacaaacatattagatgctaagaactggtgtccagacagcatggaatacaactgtccaaacctctcacctagagaggaaccagatgatattgattgttggtgttatggagtagaaaacgtaagagttgcttatggaaaatgtgatagtgcaggaagaagtagaaggtcaagacgagctatagatttacccacacatgaaaatcatggattaaaaacgcgacaagaaaagtggatgacaggtagaatgggcgaacgacaactccaaaagatagagagatggctagtaagaaatcctttctttgctgtaacagcactggcaatagcatatctagtaggtagtaatatgacacaaagggttgtaattgcactattagtattggcagtgggcccagcctatagtgcacattgtattggaataacagacagagattttatagagggtgtacacggagggacatgggtaagtgcgacattagaacaagataaatgcgtaacagtaatggctccggataaaccaagtttagatatcagcttggaaacagtagcaatagatggccctgcagaagctagaaaagtatgctatagtgcagtattaacccatgtaaaaataaacgataaatgtccaagtacaggagaagcacacttagccgaagaaaatgaaggagataatgcgtgcaaaagaacatattcagatagaggatggggaaatggatgtggactatttggtaaaggtagtattgtagcttgtgcaaaatttacatgtgcaaaaagtatgtctctctttgaagttgatcaaacaaaaatacaatatgtaataagagctcaattacacgtaggagcaaaacaagaaaattggaatgctgatataaagacactaaaatttgatgcgctatcaggatcacaagaagcagaatttacaggatatggaaaagcaacattagaatgtcaagtacaaactgcggttgattttagtaatagttatatagcagagatggaaaaagaatcatggatcgtagatagacaatgggctcaagacttaaccctaccctggcaatctggatcaggtggagtatggagagaaatgcatcatttagtagaatttgaaccacctcatgcagcaactattaaagtactagccctaggaaatcaagaaggaagtttaaaaactgcactaactggggctatgagagtaacaaaagatgcgaacgggtcaaatttatataaactgcatggaggtcacgtatcatgtagagtaaaactatctgcattaacattgaagggaaccagctataaaatgtgtacagataaaatgtcattcgtgaaaaatccaacggatacaggccatggaactgcagtaatgcaagtcaaggtaccaaaaggagcaccatgtagaatacctgtcatggtagcagacgatctcacggcagcagtaaataaagggatcttagttacagtaaatccaatagcatcaacaaatgaagatgaagtattgatcgaagttaatcccccttttggagacagctacataattgtcggtacaggagactcgagattaacatatcaatggcacaaagagggtagtagcataggtaaattgttcacgcaaacaatgaaaggagccgaaagattagcagtaatgggagatgcagcatgggatttcagcagtgccggtggattcttcacatcagtagggaaaggtatacatatggtattcggaagtgcatttcaaggactattcggtggattaagttggataacaaaagtaataataggcgcagttctgatctgggtaggtataaatatgagaaatatgacaatgtcaatgggcatgatattagtaggagtaataatgatgttcttatcattaggagtcggagcagatcaaggatgtgcaataaattttggaaaa

SEQ ID NO: 877 - RNA, 2091 nt, synthetic construct
  misc_feature 1..2091: note = derived and/or modified CDS sequence (opt6) from YFV__JF912182__X-SS-prME-XX
  source 1..2091: mol_type = other RNA
atgagaggactaagctcaagaaaaagaaggagtcaagatgtactaacagtgcaatttctaatactaggaatgttactaatggtcggaggcgtaacattagtgagaaagaataggtggctgttactaaacgtaaccagtgaagatttaggaaaaaccttctcagtaggcacaggtaattgtacaacaaatatactagaggcaaaatattggtgtcctgattcaatggagtataattgcccaaacctatcacctagagaagaaccagatgacatagattgttggtgttatggagtagagaatgtaagagtggcatatggaaaatgtgattccgctggaagaagtagaagaagtagacgagcaatcgacttaccaactcatgagaatcatggattaaaaacacggcaagaaaaatggatgacaggaagaatgggagagagacaactacagaaaatagagagatggttagtacgaaatccgttctttgcagcaacagctttggctatagcgtacttagtaggttctaatatgacacaaagagtagtaatagcactattagtattagccgtaggaccggcatatagtgcacactgcataggaataactgacagagatttcatagaaggggtccatggtggaacttgggtatctgcaacactagagcaagataaatgtgtcacagttatggctccagataaaccttcactagatatcagtttagaaacagttgcaatagacggaccagcagaagcaagaaaagtatgttattcagcagttcttacaaacgtaaaaataaatgataaatgcccatcaacaggagaagcacatttagaagaagaaaatgaaggagacaatgcttgtaaaagaacttatagtgacaggggatggggaaatggatgcggactattcggaaaaggaagcatagtagcttgcgcaaaattcgcatgcgcaaaatccatgtcactatttgaagttgatcaaacaaaaattcaatatgttattagagcacaacttcatgtaggagctaaacaagaaaattggaatacagacattaaaacattaaaatttgacgcattaagtggaagtcaagaagcagaatttaccggatacggcagagccacactagaatgccaagtacaaacagcagttgatttcagtaattcttacatagcagaaatggagaaagaaagttggatagtcgacaaacaatgggctcaagatctaacattgccatggcaatcaggatcaggcggagtatggagagaaatgcatcatctagtagaatttgagccacctcatgccgcaacaataaaagtattagcattaggaaatcaagaaggatctttaaaaacagcattgacaggagcaatgagagtaacaaaagatacaaataactctaaattatataaattacatggagggcatgtcgcatgtagagttaaactaagtgcactaacattgaagggaacatcatataaaatgtgtacagacaaaatgagttttgttaaaaacccaacagataccgggcatggaacggcagtaatgcaagtaaaagtgccgaaaggagcaccttgtagaataccagtaatggtagcagatgatctcactgcggcagttaacaaagggattctagtaactgtaaatccaatagcatcaactaatgatgacgaagtactaatagaagtgaatccaccattcggagattcatacataatagtaggaacaggagattctagattaacatatcaatggcataaagaaggaagttcaataggaaaactatttactcaaacaatgaagggagccgaaagactagcagtgatgggagatgcagcgtgggactttggaagtgcaggaggattctttacaagcgtaggaaagggtattcatacagtatttggtagtgcgtttcaaggattatttggaggactaagctggatcacgaaagtaataatgggagttgtattaatctgggtagggataaatactaggaatatgacgatgagtatgagtatgatattagtcggagtgataatgatgttcctgtctttaggagtaggggcagaccaaggttgcgcaataaattttggaaaa

SEQ ID NO: 878 - RNA, 2091 nt, synthetic construct
  misc_feature 1..2091: note = derived and/or modified CDS sequence (opt6) from YFV__JF912183__X-SS-prME-XX
  source 1..2091: mol_type = other RNA
atgagaggcttaagtagtagaaaaagacgaagtcaagatgtccttacagttcaattccttatattaggaatgctcttaatggtaggtggagtaaccttagtgagacgaaatcgatggttattattaaatgttacatctgaagatttaggtaaaacttttagcgtaggaacaggaaattgtaccactaatatattagaagcaaaatattggtgtccggacagtatggaatataattgcccaaatctatccccaagagaagaaccagatgatatagactgttggtgttatggtgtagaaaatgtaagagtggcctatggcaaatgcgatagtgcaggaagatccagacgatctaggagagcaattgacctaccaacacacgaaaatcacggacttaaaacaagacaagagaaatggatgacagggagaatgggagaaagacagctccagaaaatcgaaagatggcttgttagaaatccattctttgcagcaactgcattagcaatcgcatatctagtcggttctaatatgactcaaagagttgtaatagctttacttgtattagcagtaggaccagcatatagtgcacattgcataggaataactgacagagactttatagaaggagtgcatggtggaacgtgggtgagtgcaactttagaacaagataaatgtgttacagtaatggcacctgataagccatcattagatataagtctagaaacagttgcaatagacggtccggcagaagcaagaaaagtatgttatagtgccgtattaacaaacgtaaaaataaatgataaatgcccatcaactggagaagcacatttagaagaagaaaatgaaggagataacgcgtgtaaaaggacatatagtgatagagggtggggaaatggatgtggactattcggaaaaggatctatagtagcatgcgcaaagtttacatgtgcaaaaagtatgagcttatttgaagttgatcaaacaaagatacaatacgtaatcagagcacaactacatgtaggagcaaagcaagaaaattggaatactgatataaaaacattaaaatttgacgccttaagtggatcacaagaagctgagttcacaggatatggtaaggcaacactagaatgtcaagtacaaacagcagtagacttttccaacagttatattgctgaaatggaaaaagaaagttggattgtagataaacaatgggctcaagatctaacattaccatggcaaagcggaagcggtggagtatggcgagaaatgcatcacttagttgaatttgaaccacctcatgcagcaacaataaaagtattggccctaggaaatcaagaaggatcactgaaaacagcattaacgggtgcaatgagagtaacaaaagacacaaataattcaaaactatataaattacatggtggacatgtagcatgcagagtaaaattgtcagcactaacacttaaaggaacctcatataaaatgtgtacggacaaaatgtcgttcgttaaaaatccaacagatacaggtcacggtacagctgtaatgcaggtaaaagttcctaaaggagcgccatgtagaataccagtaatggttgcagatgacttaactgcggcagttaataaaggcatattagtaacagtaaatccgattgcaagtacaaatgacgatgaagttctaattgaagtaaatccaccattcggagatagttacataatagtaggaacaggagactcaagacttacatatcaatggcataaagaaggtagtagcataggtaaattatttacgcaaacgatgaaaggagcagaacgactcgcagtgatgggagatgctgcatgggactttggaagtgcaggagggttctttacaagtgtaggaaaagggattcatacagtgtttggaagcgcatttcaaggactatttggaggactgtcttggataacaaaagtaataatgggagtagtattgatatgggtaggaattaatacaagaaatatgacaatgtcaatgtcaatgatattagtaggcgtaattatgatgtttttaagtctaggagtaggcgcggaccaaggatgtgcaataaactttggaaaa

SEQ ID NO: 879 - RNA, 2091 nt, synthetic construct
  misc_feature 1..2091: note = derived and/or modified CDS sequence (opt6) from YFV__JF912184__X-SS-prME-XX
  source 1..2091: mol_type = other RNA
atgagaggattaagttcaagaaaacgacgctcacaagatgcattaactgtacaattcttgatactaggaatgctattgatggtaggaggggtaacgttagtgaggaggaaccgatggttattacttaatgtaacatcagaggatctaggaaaaaccttcagtgtaggaactgggaattgcacaacaaatatattagaagcaaaatattggtgtcctgattctatggaatacaattgtccaaatttaagtccaagagaagaaccagatgatatagattgttggtgttatggagtagaaaatgttagagtagcttacgggaaatgtgatagtgcaggtagaagtaggagaagcagaagggcaatagacctacccactcatgaaaatcacggactaaaaacaagacaagaaaaatggatgacaggacgtatgggagaaagacaactacaaaagatagaacgttggctagtaagaaatccattctttgcggctacagcattagcaatagcataccttgtaggatctaacatgacccaacgagtagttatcgcgctattggtactggcagtaggtcctgcttattcagcacactgcataggtataacagatagagattttatagaaggtgtacacggtggtacatgggtaagtgcaactctagaacaagataaatgtgtaacagtaatggcaccagacaaaccaagtttagatataagtttagaaacagtagcaatagacggacctgcggaagccagaaaagtatgttatagcgcagtccttacaaatgttaaaattaatgataaatgtccatcaactggagaggcgcatctagaagaagaaaacgaaggggataatgcatgcaaaagaacatacagtgatagaggttggggaaatggctgtggattatttggtaaaggaagtatagtagcatgcgcaaaatttacatgcgctaaaagtatgagcctatttgaagtagatcaaactaaaatacaatatgttataagagcacaattacatgtaggagcaaaacaagaaaactggaatacagacataaaaactttaaaatttgatgcacttagcggatcacaagaggcagaatttacaggatatggaaaagcaactctcgaatgtcaagtacaaacggcggtagatttcagtaatagttatattgcagaaagagaaaaggaatcatggatagtggacaagcaatgggcacaagatttaactttaccatggcaatcaggatcaggtggtgtttggagagaaatgcaccatctagttgagttcgaaccaccccatgcagctacaattaaagtattagcattaggaaatcaagaaggatcattaaaaacagcactaacaggtgcaatgagagtcactaaagacactaataattcaaaactgtataaactacacggcggacatgtagcatgtagagtaaaattgagtgctttaacacttaaaggaacatcatacaaaatgtgtacagacaaaatgtcattcgttaaaaatccaacagacacaggtcatggtacagcagtaatgcaagtaaaagtaccaaaaggagcaccctgcaggattccggttatggtagcggacgatctaacagcagcagtaaacaaaggaatattagtaactgtgaatccaatagcatctacaaacgacgatgaagtacttatagaggttaatccaccattcggagacagttatataattgtcggaacaggtgattccagactaacatatcaatggcataaagaagggagcagtataggaaaattattcactcaaacaatgaaaggagcagaaagattagcagtaatgggagacgcagcatgggatttcgggagtgccggtggatttttcacaagtgtaggcaaaggaatacatactgtatttggaagtgcatttcaaggactatttggaggattatcatggataactaaagtaataatgggagtagtcctcatatgggttggtattaatacaagaaatatgacaatgtcaatgtcaatgatattagtaggggtaataatgatgtttttatctttaggtgtaggagcagatcaaggatgtgctataaatttcggaaaa

SEQ ID NO: 880 - RNA, 2091 nt, synthetic construct
  misc_feature 1..2091: note = derived and/or modified CDS sequence (opt6) from YFV__JF912185__X-SS-prME-XX
  source 1..2091: mol_type = other RNA
atgagaggacttagctcaaggaaacgaagatcgcaagatgttctaacagtacaattccttattctaggaatgctattaatggttggaggagtgacccttgttaggaaaaatagatggttactgttaaatgtaacaagtgaagatttaggcaaaacattttccgtaggaacaggaaattgtacaacaaatattctcgaagcaaaatattggtgtcctgattctatggaatataattgcccaaatttatcaccaagagaagaaccagatgatatagattgctggtgctatggagtagaaaatgtaagagtagcatatggtaagtgtgattcagcaggaagaagtagaagaagtagaagggctatagatcttccaacacatgaaaaccatggtttaaaaacaagacaagagaaatggatgactggcagaatgggagaaagacaattacagaaaatagagagatggttggtcaggaatccattctttgccgctacagcacttgcaatagcatatttggtagggagtaatatgactcaaagggtagttattgcactattagttctagcagtaggaccagcgtatagtgcacattgtataggaataacagacagagattttatagagggagtacatggaggaacttgggtttcagctacattagaacaagacaagtgtgtaactgtaatggcacctgataaaccaagtctagacataagcctagaaacagtagcaatagatggcccggcagaagcgagaaaagtgtgttatagtgcagtattaacgaatgtaaaaataaatgacaaatgtccatcaacgggagaagcacatttagaagaagaaaacgaaggagataatgcttgtaaaagaacatactcggacagaggctggggtaacggatgcggattgtttggaaaaggtagtatagttgcatgcgctaaatttacctgtgcgaaaagcatgagtttattcgaggtagaccaaacaaaaatacaatatgtaataagagctcaactacacgtcggggcaaaacaagaaaattggaatacagatataaaaacattaaaatttgatgcgttatcaggcagtcaagaggcagaatttacagggtatggtagagcaacattagaatgccaggttcagacagcagtagattttagcaattcatatatagcagaaatggaaaaagaaagttggattgtcgataaacaatgggcgcaagatttaacactgccttggcaatcgggatctggaggagtatggagggaaatgcatcatctagtagaatttgaaccaccacatgctgcaacaataaaagtcttagcattaggaaatcaagaaggatctttaaaaacagcattaacaggagctatgagagtaacaaaagatactaataatagtaaattatataaactacatggtggacacgtagcctgtagagtcaaattaagtgcactaactctaaaaggaacaagttacaaaatgtgtacggataaaatgagttttgtcaaaaacccaaccgatacaggacacggtacagcagtaatgcaagtaaaagtaccgaaaggggcaccatgtaggataccagttatggtagcggacgacttaactgccgcagtaaataaaggaatattagtcacggtaaatccaatagcatcaactaatgatgatgaagtattaatagaagttaatccaccattcggagatagctatataatagttggtacaggagactcaagattgacctatcagtggcacaaagagggaagcagcatagggaaactgtttacacagacgatgaaaggagcagagagattagctgtaatgggtgatgctgcatgggattttggaagtgcaggaggattctttacgtctgtaggaaaagggatacatacagtatttgggtcagcatttcaaggattatttggaggattaagttggataacgaaggtaataatgggagtggtactcatatgggtcggaataaacaccagaaatatgacaatgagcatgagtatgatattagtaggagtaataatgatgtttttaagtttaggagtaggtgctgatcaagggtgtgctataaatttcgggaaa

SEQ ID NO: 881 - RNA, 2091 nt, synthetic construct
  misc_feature 1..2091: note = derived and/or modified CDS sequence (opt6) from YFV__JF912186__X-SS-prME-XX
  source 1..2091: mol_type = other RNA
atgagaggactatcaagcagaaaacgaagatcacaagatgtgttaacagtacaattcttaatattaggtatgttactaatggtaggcggagttacattagtaagaagaagcagatggttacttctaaacgtaaccagtgaagacttgggtaaaactttttcagtaggaacaggaaattgcactacaaatatattagaagctaaatactggtgtcctgacagcatggaatataactgtccaaatttaagtccaagagaagaaccagatgacatagattgctggtgctatggtgtagaaaatgtaagagttgcctatggaaaatgcgattcagcaggaagatcaagaagaagcaggagagctatagatttaccaactcatgaaaatcatggactaaaaacaagacaagaaaaatggatgacaggacgaatgggtgaaagacaattacagaaaatagaacgatggctagttagaaatccattcttcgctgcgacagcattagcaatagcttatttagtaggatcaaatatgactcaacgagtagtaatagcattattggtacttgccgttggtccagcatactcagcacattgtatcggaattacggatagagattttatcgaaggagtacatggaggtacttgggttagcgcaacattggaacaagataaatgtgtaaccgtgatggcgccggataaaccaagtctagatatatcattagaaacggtcgcaatagatggacctgctgaagcacgtaaagtatgttattccgcagtattaacaaatgtaaaaataaatgataaatgccctagcacaggcgaagcacatcttgaagaagaaaatgaaggggataatgcttgtaaaaggacatacagtgatagaggatggggaaatggatgtggtttattcggaaaaggctccatagtagcatgcgctaaatttacgtgtgcaaaaagtatgtcgctattcgaagtagaccaaacaaaaatacaatatgttataagagcacaattacatgtaggagccaaacaagaaaattggaatacagatattaaaacattaaaatttgatgcattaagtggaagccaagaggccgaatttacaggatacggaaaagcaacattagagtgccaagtacaaacggcagtagattttagtaatagctacatagcagaaatggaaaaagaatcatggattgtggataaacaatgggcacaagatttaaccttaccatggcaatcaggaagtggaggagtatggcgagaaatgcatcatctagttgaatttgaaccaccacatgctgcaacaattaaagtattagcccttggaaaccaagaaggatcactaaaaacagcattaacgggtgcaatgagagtaacaaaggatacaaataattcaaaactatacaaactacatggaggacacgttgcttgcagagtaaaattaagcgcgctgacccttaaaggaacatcatataaaatgtgtacagataaaatgtcatttgttaaaaatcccacagatacaggacatggaacagctgtaatgcaagtaaaagtacccaaaggagctccgtgcagaataccagtaatggttgcggatgatttaaccgcagctgtaaataaaggaattttagtcactgtaaatcctatagcatcaacaaatgacgatgaagttctaatagaagtgaatccaccatttggggatagctatataatcgtaggtacaggagatagtcggctaacctatcaatggcataaagagggatcatcgattggaaaactatttacacaaaccatgaagggagctgaaagattagcagtaatgggagatgcagcttgggacttcggaagcgcgggtggtttctttacttcagtggggaaagggatacacacggtatttggatcagcatttcaaggactatttggaggactgtcatggataaccaaagtaataatgggagtagtattaatttgggtaggaattaatacaagaaatatgacaatgagcatgagcatgattctagtaggagtaataatgatgtttttaagtctaggtgtaggggcagaccaaggttgcgctataaattttggaaaa

SEQ ID NO: 882 - RNA, 2091 nt, synthetic construct
  misc_feature 1..2091: note = derived and/or modified CDS sequence (opt6) from YFV__JF912187__X-SS-prME-XX
  source 1..2091: mol_type = other RNA
atgagaggattaagctcaagaaaaagaagatcacaggatgtactaacagtacaatttttgatattgggaatgttgttaatggtaggaggtgtaacattagttcgaaggaacagatggctattattaaatgttacttcggaagatctagggaaaacattctcagtgggcactggaaattgtacaaccaatatattagaagccaaatattggtgttcagactcaatggaatataactgtccaaatttatcaccaagagaagaaccagatgatatagactgttggtgctatggagtagaaaacgtaagagtggcttatggcaaatgcgatagtgcaggcaggagcagaaggagcaggagagcaatagacctaccaacgcatgaaaatcacggattaaaaacaagacaagaaaaatggatgacaggaagaatgggcgagagacaattacagaaaatcgaaagatggttagtaagaaatccattctttgcagcaacagctttagcaatagcatatttagtagggtcaaatatgacgcaaagagtagtgattgcactattagtattggcagtggggccagcatattcagctcactgcataggtattacagatagagattttatagaaggtgtacatggtggaacatgggtatcagctacacttgaacaagataaatgcgtaacagtaatggcccccgataaaccatcacttgatatatcgttggaaacagtagcaatagacggccccgcagaagcaagaaaagtatgctacagtgcggtccttacaaatgtaaaaattaacgataaatgtccgagtacaggagaagcacatctagaagaagaaaatgaaggcgataatgcttgcaaaagaacatatagtgatagaggttggggtaatggatgcggattatttgggaaaggaagtatagtagcatgtgctaaatttacatgtgcaaaatctatgagtctatttgaggtcgatcaaacaaaaatacaatatgttattagagcacaattacatgtgggagcaaaacaagaaaattggaacacagatataaaaacattaaaatttgacgctctttctggatcacaagaagcagaatttacgggatatggaagggctacgttggaatgtcaagtccaaacagcggtagacttcagtaattcatatatagcagaaatggagaaagaatcatggattgtagataaacaatgggcacaagatttaacattaccatggcaaagtggaagtgggggagtttggagggaaatgcatcacctagtagaatttgaaccgccacatgcagcaacaataaaagtgttagcacttggaaaccaagaaggcagtttaaaaaccgcactcacgggagctatgagagtcactaaagatacaaataatagtaaactatacaaactacacggaggacatgtggcatgccgagtaaaattgagtgcattaacactaaagggaacaagctataaaatgtgtacagataaaatgtcgttcgtgaaaaatccaacagatacaggacatggaacagcagtcatgcaggtaaaagtaccaaaaggggcaccatgcagaataccagtaatggtcgcagacgatttgacggcagcagtaaataaaggaatattagtcacagtaaatccaatagcttcaacaaatgatgatgaagtacttatagaggttaatccaccgttcggagatagctacataatagttggaacaggagactcgagattaacataccaatggcataaagaaggaagttcaatagggaaactatttacacaaacaatgaagggagcagaaagactagcagtaatgggagatgccgcatgggattttggaagtgctggaggattctttacatcagttggaaaagggattcatacagtatttggatcagcatttcagggattatttggaggattgtcatggattacaaaagtaataatgggagtagtattaatttgggtaggcataaacactagaaatatgacaatgtcaatgagtatgattttagtaggagtaataatgatgtttttatcattaggagtaggagcagatcaaggatgtgcaataaattttgggaaa

SEQ ID NO: 883 - RNA, 2091 nt, synthetic construct
  misc_feature 1..2091: note = derived and/or modified CDS sequence (opt6) from YFV__JF912189__X-SS-prME-XX
  source 1..2091: mol_type = other RNA
atgaggggattaagcagtagaaaacgaagatcgcaagacgtattaacagtacaatttttaatattaggaatgttactaatggtaggaggtgttacattagtaagaagaaatcgttggttactattaaatgtaacaagtgaagatcttggtaaaactttctcagtaggcactggcaattgtactacaaacatactagaagctaaatattggtgtccagatagtatggaatataactgtccgaatttatcaccaagagaagaacccgacgatatagattgttggtgttatggtgtagaaaacgtaagagttgcatatggaaaatgtgactcagcaggcagatctagacgatcacgcagagcgatagacttaccaacacatgaaaatcatggactgaaaaccagacaagaaaaatggatgactggcagaatgggagaaagacaattacagaaaatagaacgatggctagtcagaaatccatttttcgcagcaacagcgctagcaatagcatatttggtaggaagtaatatgacacaacgagtagtaatagcactattagttctagcagtaggcccagcatattccgcacactgcataggaataacagatagggattttatagaaggagtacatggaggaacttgggtaagtgcgacactagagcaagataaatgcgtaacagtaatggcaccagataaaccaagcctagacatatcactagaaacagtagcaatagatggaccagcagaagcaagaaaagtatgttatagcgctgtgttaacaaatgttaaaataaacgacaaatgtccatcaacaggcgaagctcatttggaagaagaaaatgaaggagataacgcatgcaaaagaacatattcagatcgaggctggggtaacggttgtggactattcggaaaaggaagtatagtcgcatgtgcgaaatttacttgtgctaagtcaatgagtctattcgaagtagaccaaacaaaaatacaatacgtaatacgagcacaattgcatgttggcgtaaaacaagaaaattggaacacggatataaaaaccctaaaattcgatgcactaagtggaagtcaagaagcggaatttacaggatatggtagagcaacattagaatgtcaagtacaaacagcggtagactttagcaattcatatatagcagaaatggaaaaagaatcttggatagtagataaacaatgggcacaagacttaacactaccttggcaaagtggaagcggaggagtttggcgagaaatgcatcatttagtagagttcgaaccacctcacgcagcaacaataaaagttcttgcattaggaaatcaagaaggatcactcaaaacagcattaacgggagcaatgagagtaacaaaagatacaaacaatagcaaattatataagttacacggtggacatgtagcttgcagagtaaaattgagtgcattaactctcaaaggcacttcatataaaatgtgcacagataaaatgtcttttgtcaaaaatccgacagatacaggccacggaaccgcagtaatgcaagtaaaagtacctaaaggagctccatgtaggattccagtaatggtggcagatgacctcacagcagcagtaaacaaaggaatcttagtaacagtaaatccaatagcatcaacaaacgatgatgaagtactaatagaagtaaatcctccatttggcgattcctatataatagtggggacgggagatagcagactaacataccaatggcataaagaaggatcttcaatcggaaaattatttacgcaaacaatgaaaggagcagaaagactagcagtaatgggagacgcagcatgggattttggatcagcaggaggctttttcacaagtgtaggaaaaggtattcacacagtattcggaagtgcatttcaaggactattcgggggtctaagctggataacaaaagtaatcatgggagttgtattaatttgggttggaattaacacaagaaatatgacaatgagtatgtctatgatattagtaggagttattatgatgtttctgtcattaggagtcggtgcagatcaaggatgtgcaattaattttggaaaa

SEQ ID NO: 884 - RNA, 2061 nt, synthetic construct
  misc_feature 1..2061: note = derived and/or modified CDS sequence (opt6) from YFV__AH005112__X-SS-prME-XX
  source 1..2061: mol_type = other RNA
atgagaggattatcaagtagaaaacgtaggtcacacgacgttctaacagtccaatttctaattttaggaatgctgctaatggcaggaggagtaactttagtaagaaagaacagatggttactattaaatgtaacaagtgaagatttaggaaaaacatttagtgttggaacaggaaattgtacaacaaacatattggaggcaaaatactggtgccccgacagcatggaatacaactgtccaaatctaagtccccgagaagaaccagatgacatagattgttggtgttatggagtagaaaatgtaagagtagcatatggaaaatgtgatagtgcaggtaggtcgagacgttcaaggagagcaattgatttgccaacacacgaaaaccatggattaaaaacaagacaagaaaaatggatgactggacgtatgggagaacgacaattacagaaaatagaaagatggttagtaaggaatccgttctttgcagtaacagcattaacgatagcttatctagtaggatcaaacatgacacaaagagtagtaatagcattattagtattagcagtaggaccagcatattcagcgcattgtataggaataacagatagagattttatagaaggagttcatggaggaacatgggtaagtgctacattagaacaagataaatgtgtaacagttatggcaccagacaaaccaagcctagatattagtctcgaaacagtggcaatagatggcccagcggaagcaagaaaagtttgctacaatgcagtattaactcacgtaaaaataaatgataaatgtccaagcacaggggaagcacacctagcagaagaaaacgaaggagacaatgcatgcaaaaggacatattcagataggggatggggaaatggttgtggtctctttggaaaaggaagtatagtagcctgcgcaaaatttacatgtgcaaaaactatgagtttatttgaagttgatcaaacaaaaatacaatatgtgataagagcacaactacatgtaggggcaaaacaagaaaattggaacacagatattaaaactttaaaatttgacgcactaagtgggtcacaagaagccgaatttacaggatacggaaaagctactctagaatgtcaagtacagacagcagtagattttggaaatagttatatagctgaaatggaaaaagaatcatggatcgtagatagacaatgggctcaagatttaacattaccatggcaatcaggaagcggaggtgtatggagagaaatgcatcatctggtagaatttgaaccaccacacgcagcaactataagagtcctggcactaggcaatcaagaaggaagcctaaaaacagctttaacaggagcaatgagagtaacaaaagacacaaatgataataatttatataaactacacggaggtcatgtatcttgtcgagtaaaactaagcgcgttaacgctaaaaggaacttcatacaaaatgtgtacagataaaatgtcgtttgtgaaaaatcccacagacaccgggcatggtacagtagtaatgcaggttaaggtaccaaaaggggctccatgcaaaataccagtaatagtagcggacgatttgaccgcagcaattaacaaaggcattttggtaacagtaaatccaatagcttcaactaacgatgatgaagttctaatagaagtaaacccaccgtttggagacagctacataatagttggtacaggagatagcagattaacataccaatggcacaaagaaggaagttctataggaaaattatttacacagacaatgaggggtcaagaaagattagcagtaatgggagatacagcatgggacttcagttcagcgggaggatttttcacaagtattggtaaaggaatacatacagtgtttggatcagctttccaaggattatttggaggattaagctggattactaaagtaataatgggagcagttctaatatgggttgggataaacacacgaaatatgacaatgtcaatgagcatgatattagtgggagtaataatgatgtttttatcattaggagtaggtgca

SEQ ID NO: 885 - RNA, 2091 nt, synthetic construct
  misc_feature 1..2091: note = derived and/or modified CDS sequence (opt6) from YFV__FJ654700__X-SS-prME-XX
  source 1..2091: mol_type = other RNA
atgagaggactttcaagtaggaaaaggagatcacatgatgttttaactgtccaattcttaatacttggaatgctactaatgactggaggagttacattagtaaggaaaaacagatggctactattaaacgtaacatctgaagacttaggaaaaacatttagcgtaggaacaggaaactgtacaacaaatattctagaagcaaaatattggtgtccagacagcatggaatataattgtccaaatcttagtccgagggaggaaccggacgacattgactgttggtgctatggagtagaaaacgtaagagtggcatatgggaaatgcgacagtgcaggaagatcgagaaggagtcggagagcaatagatttgcccactcatgaaaatcatgggctaaaaacaagacaagaaaaatggatgactggaagaatgggagaaaggcaactgcagaaaatagaaagatggtttgttaggaatcctttctttgcagtaaccgctttaacgatagcatatttagtaggaagcaatatgactcaaagagtagtaatagcattattagtactagcagtaggaccagcgtattccgcacactgcatcggaataacagacagagactttattgaaggagtacatggaggtacatgggtttcagcaacactagaacaagataaatgtgtgacagtaatggcgccagataaaccaagcctggatataagtctagaaacagtagctattgacagaccagctgaagttcgaaaagtatgttacaatgcagttttaacacatgtaaaaataaatgataaatgcccaagtactggagaagcccacctagcagaagaaaatgaaggagataatgcgtgtaaaagaacatattcagatagaggttggggaaatggatgtggactctttggaaaagggagtatagtagcgtgtgcaaaatttacctgcgcaaaatcaatgagcttatttgaagtagatcagacaaaaatacaatatgttatcagagctcaactacatgttggagcaaagcaagaaaattggaatactgatataaaaaccctaaaatttgatgctttaagcggatctcaagaagtagaatttacaggatacggaaaggcaacgttagaatgccaagtacaaacagcagtcgattttggaaactcatatatagccgaaatggagactgaaagctggattgtcgatcgacaatgggcgcaagacttaacgttgccctggcaaagtggctcaggtggggtatggagggaaatgcatcatctagtagaatttgaaccaccacacgcggtaacaataagggtcttagcgttaggaaatcaagaaggctcactaaaaacagcattaacaggagcaatgagagtaacgaaggatactaatgataacaacctatacaaattacacggagggcacgtgtcatgtagagtaaaactaagtgcactcacactaaagggaacaagttacaaaatatgtactgataaaatgttctttgtcaaaaaccccacagacacaggacacggaacagtagtaatgcaagtaaaagtatcaaagggagccccatgtaggattccagtaatagtagcagatgatcttacagctgcaataaataaaggaatattagtaacagttaatcccattgccagcactaacgacgatgaagttctgattgaagtaaatccaccatttggagatagttacataatagttggaagaggagattcacgattgacatatcaatggcataaagaaggaagttcaatagggaaattattcacacaaacaatgaaaggagtagaaaggttagcagtaatgggtgataccgcctgggactttagtagcgctgggggatttttcacaagtgttggaaaaggaatacacacagtatttggtagtgcattccaaggattattcggaggattgaattggataacaaaagtaataatgggagcagttttaatatgggtagggattaatacaaggaatatgacaatgtccatgtcaatgatattagtcggagtaataatgatgtttttaagcctaggagtaggagcagaccaaggatgtgcaataaattttggaaaa

SEQ ID NO: 886 - RNA, 2091 nt, synthetic construct
  misc_feature 1..2091: note = derived and/or modified CDS sequence (opt6) from YFV__KM388817__X-SS-prME-XX
  source 1..2091: mol_type = other RNA
atgagaggcttaagttcaaggaaaagaaggagtcaagatgtattaacagtgcaattcttaatattaggtatgttattaatggcaggaggagttacgttggtaagaaggaatagatggttattattaaacgtgacatctgaagatcttggaaaaacattctcagtaggaaccggaaattgcacaacaaatatccttgaagcaaaatattggtgtccagatagtatggaatacaattgtcctaatttaagtccaagagaagaaccagacgatatagattgttggtgctacggggtagagaatgtaagagtagcatatgggaaatgtgattcagcaggtagatcaaggagatcaaggagagcaattgatttaccaacacatgaaaatcatggcttaaagacaagacaagaaaaatggatgacgggaagaatgggagaaagacaattacaaaagatagagagatggcttgtgagaaatccattctttgcagcaacagctttaacaatagcctacctagtgggaagcaacatgacacaaagagtagtaattgcactattagttttagcagttggaccagcatatagtgcgcactgtataggtattactgatcgtgattttatagaaggagtacatggaggaacatgggtaagcgcaaccttagaacaagacaaatgtgtgacagttatggcacctgataagccgagtctagacatctctctcgaaactgtagcaatagacggaccagcagaagcacgcaaagtatgctatagtgctgtattaacaaatgtaaaaataaatgataaatgtccaagtacaggcgaggcccatttggaagaagaaaatgaaggagacaatgcatgtaaaagaacatatagcgatagaggatgggggaatggatgtggactatttggaaaaggtagcattgtagcatgtgcaaaattcacatgcgcaaaatcaatgagtctcttcgaagtagaccaaacaaaaatacaatatgttatcagagcacaattacatgtgggagcaaaacaagaaaattggaataccgacattaagacactaaagtttgatgcactaagtgggagtcaagaagccgaatttacgggttatggtagagcgacattagaatgtcaagtacaaacagcagtagatttttcaaatagctatatagctgaaatggaaaaggaaagttggatagtagataaacaatgggcgcaagatctaacattgccatggcaaagtggatcaggaggagtatggagagaaatgcaccatttagtagaatttgaaccaccgcatgcagccacaataaaagtattagccctaggaaatcaagaaggaagcctaaaaacagctttgacaggagcaatgagagtaacaaaggatacaaataatagcaaattatataaactacatggtggacatgtagcatgtagagtgaaattatcagctctaactttaaaggggacatcatataagatgtgtacggacaaaatgtcattcgtcaaaaatccaacagatacaggacatggaacagcggtaatgcaagtaaaagtacctaaaggagcaccatgcagaatacctgtaatggtagcagacgatctaacagcagctgtaaataaaggaatattagttactgtaaacccaatagcctcgactaatgatgatgaagtactaattgaagtaaaccctccatttggcgactcatatataatagtaggaacaggcgattcacgattaacatatcaatggcataaggaaggatcaagcataggtaaattatttactcagaccatgaaaggtgcggaaagattggcagtaatgggagatgcagcttgggacttcggctctgctggtggatttttcactagcgtagggaaaggaatacatactgtatttggaagtgcatttcaaggattatttgggggattatcatggataacaaaagtgataatgggagtagttttgatatgggtaggaataaatacaagaaatatgacgatgtcaatgtcgatgatattagtaggcgtaataatgatgtttttatccttaggagttggagcagaccaaggttgtgcaataaattttgggaaa

SEQ ID NO: 887 - RNA, 2091 nt, synthetic construct
  misc_feature 1..2091: note = derived and/or modified CDS sequence (opt6) from YFV__HM582851__X-SS-prME-XX
  source 1..2091: mol_type = other RNA
atgagaggattaagtagtcgcaaaagaagatcacaggatgttttaacagtacaatttctcatactaggaatgttattaatggtaggaggagtaacattagtaagaagaaatagatggttattactaaatgtaacaagcgaggacctgggcaaaacttttagtgtaggaacaggaaattgcacaacaaatatactcgaagccaaatattggtgtccagatagcatggagtataactgcccaaacttatcaccaagagaagaacctgacgatattgattgttggtgctacggtgtagaaaacgtaagagttgcttacggcaaatgtgatagcgcgggcagaagcagaagatcaaggagagcgattgacttaccaacacatgaaaatcatggattaaagactagacaagaaaaatggatgacaggaagaatgggtgagagacaattacagaaaattgaaaggtggctagtaagaaatccattctttgccgcaacagcactagcaatagcatacttagttggcagtaatatgacacaaagggtagtaatagcattattagtgttagcagtaggaccagcatatagtgcacactgcattggaataactgatagagatttcatagaaggtgtacatggcggaacatgggtgagtgctacattagaacaagataaatgcgttacagtaatggccccagacaaacccagtctagatataagtttagaaactgtagctatcgatggaccagcagaagcaagaaaagtttgctacagtgctgtattaacaaatgttaaaataaatgataaatgtccatcaacaggtgaagcccacttagaagaagaaaatgaaggagataacgcatgtaaaagaacgtattccgatagaggttggggcaatggatgtggtttgtttggaaaaggatcaatagtagcttgtgcaaaatttacatgcgctaaaagtatgagcttatttgaagtagatcaaactaaaatacaatatgtaattagagcacaattacatgtaggagcaaaacaagaaaattggaatacagacataaaaaccctaaaatttgatgcattaagtggaagtcaagaagcagaatttacaggatacggaagggcaaccttagaatgtcaagttcaaactgctgtagatttcagtaactcttatatagctgaaatggaaaaagaatcatggatagtagataaacaatgggcccaagatttgacattaccttggcagtccgggtcaggaggggtatggagagaaatgcatcatttagtagaatttgaaccaccacatgctgctactattaaagttctggctttaggaaatcaagagggatcattaaaaacagctctaacaggtgctatgagagtaaccaaagacacaaacaactcaaagctatacaaactacatggaggacatgtagcatgtagagtaaaattaagcgctctaactctaaagggaacaagttacaaaatgtgtacagataaaatgtcatttgtgaaaaatcccacagatactggacacggcactgctgtaatgcaagtgaaagtaccgaaaggtgcaccatgtagaatacctgtaatggtagctgatgatttaactgcagcagtaaataaaggaatacttgtaacagtaaatccaatagcttcaacaaacgatgatgaagtattaatagaagtaaatccaccattcggtgattcatatataatagtaggaactggagatagtagactaacatatcaatggcacaaagaaggaagcagtatcgggaaactatttacacaaactatgaagggggcagaacgattagctgtaatgggtgatgcagcttgggattttggctcagctggtggatttttcactagcgtaggtaaaggaatacatacagtattcggatcagcatttcagggattatttggaggactaagctggataactaaagtaataatgggcgtagtattaatatgggtgggaatcaataccagaaacatgacaatgagcatgagcatgattctagtaggagtaataatgatgtttctctctttaggagttggagcggatcaaggatgtgcaattaattttggcaag

SEQ ID NO: 888 - RNA, 2091 nt, synthetic construct
  misc_feature 1..2091: note = derived and/or modified CDS sequence (opt6) from YFV__JN620362__X-SS-prME-XX
  source 1..2091: mol_type = other RNA
atgaggggattatcatcaagaaaacgacgatcaaatgaaatgactatgatgccattgttaatattatcaatggttattctagcaggaggagtaacattagtcagaaagaatagatggttgttattaaacgtgacggccgaagacttaggtaaaactttttcagtcggtacaggaaattgtacaacaaatatattagaagcaaaatattggtgtccagatagtatggaatacaactgtccaaatctaagcccaagagaagaaccagatgacatagattgctggtgttatggagtagaaaacgtccgagtagcatatggaagatgtgatgcagtaggtagatcaaaaagatcaagaagggctattgacttaccaacacatgaaaatcatggtctaaaaacaagacaagaaaaatggatgacaggaagaatgggagaaagacaattacagaaaatagaaagatggctagttagaaatccatttttcgcaataacagcattagcaatagcatatttggtcggaaataacatgacacaaagagtagtaatagcgctacttgttctagcagtaggtcccgcttattcagcacattgtataggaataactgacagggattttatagaaggagttcacggaggtacatgggtcagtgctactttagaacaagacaaatgtgttacagtaatggcaccagataaacctagtttagacataagtttgcaaacagtagcgatagatggccctgccgaagcacgtaaagtgtgttattcagctgtattaacacatgtaaaaataaatgacaaatgtccatcaacaggagaggcacatctagcggaagaaaatgatggcgacaatgcatgtaaaagaacatattcagatagaggttggggtaatgggtgcggactttttggcaaaggaagtatagtagcatgtgcaaaattcacatgtgcaaaaagtatgagtttattcgaagttgatcaaacgaagatacaatatgttatacgagcccaactacacgtaggagcaaaacaagagaattggaatacagacataaaaactctgaaatttgatgcactatccggttctcaagaagcagaatttactggatatggtaaggcaacattggaatgtcaagtacaaacagctgtagattttggaaactcttatatagcagaaatggaaaaagatagttggattgtagatagacaatgggcacaagatttaacattaccatggcaatcaggtagtggtggaatatggagagaaatgcatcatttggttgaatttgaaccacctcacgcagcgaccataagagtattagccttaggaaatcaagaaggaagtctaaaaactgcacttacaggggcaatgagggtaacgaaagatgaaaacgataataatctgtacaaattacatgggggacatgtaagttgcagagttaagctctcggcattgacgctaaaaggaacgtcatataaaatgtgcactgataaaatgagttttgtcaaaaatcctaccgatacaggacatggaaccgtagtaatgcaggtaaaagtaccaaaaggagcaccatgcaaaataccagtaatagtagcagatgatcttacagcagcagttaataaagggatattagtaacagtaaatcctattgcgtcgactaatgatgatgaagtattaatagaagtaaatccaccattcggggattcgtatataatagtaggaacaggagatagtagattaacatatcaatggcataaagaaggatcttcaattggcaaactatttacacaaacaatgaaaggcgcagaaagattagcagttatgggagatgcagcatgggacttctcaagtgctggcggattctttacatcagtaggaaagggtatccacacagtatttggcagtgcatttcaaggattatttggaggcctatcatggataacgaaagttataatgggagcagttttaatatgggttggtatcaatacaagaaatatgactatgagtatgagcatgatattggtaggagtaataatgatgtttttaagtctaggagtaggagcagatcagggatgtgcggtcaattttggtaaa

SEQ ID NO: 889 - RNA, 2091 nt, synthetic construct
  misc_feature 1..2091: note = derived and/or modified CDS sequence (opt6) from YFV__JN811142__X-SS-prME-XX
  source 1..2091: mol_type = other RNA
atgcgcgggctatcatctagaaaacgaagaagtcacgacgttctaacagtacaattcttaatacttggaatgctactaatgacaggtggagtaacattagttaggaaaaatagatggttactactaaacgtaacaagtgaagatttaggaaaaacattttctgtaggaacaggtaattgtacaacaaatattctagaagctaaatattggtgtcccgatagtatggaatacaactgcccaaatctaagtcctagagaagaaccagatgatatagactgttggtgctatggagtagaaaacgtgagagtggcttatggtaaatgtgattcagcaggaagaagtagaaggagtcgacgagcaatcgatttaccaacccatgaaaatcatggtctgaaaacacgacaagaaaaatggatgactggaagaatgggcgaacgtcaattacagaaaatagaaagatggtttgtgcgaaatccattcttcgccgttaccgcgttaacaatagcatatctagtaggatctaatatgacacaaagagtagttatagctctattagtactagcagttggaccagcatatagtgcacactgtataggaattacagaccgcgattttatagaaggcgtacacggtggaacatgggtaagtgcaacattagaacaagataaatgtgttacagttatggcaccagataagccatcattagatatatcattagaaacagtagcaatagatagaccagcagaagtacgtaaagtatgctataacgcagtactcactcatgtcaaaataaacgataaatgtccaagcactggcgaagcacatttggcagaagaaaatgaaggagataatgcatgcaaaagaacatacagcgatcgaggctggggtaacggatgtggactattcggtaaaggaagtatagttgcatgtgcaaaatttacatgtgcaaaatcaatgtcattatttgaagtggaccaaacgaaaatacaatacgtcataagagcacaacttcatgttggcgctaaacaagaaaattggactacagatataaaaacattaagatttgatgctctgagtggatctcaagaggtagaatttataggctatggaaaagccaccttagaatgtcaagttcaaaccgcagttgacttcggcaatagttacatagctgaaatggaaacagaatcctggatagtagatcgacaatgggctcaagatttaacgttgccatggcaaagtggatcaggaggagtatggagagaaatgcatcatttagtggaatttgaaccaccacatgctgctacaatcagagtactagcactaggcaatcaagaaggaagtttaaaaacagccctaacaggtgcaatgagggtaactaaagatacaaatgataataatttatacaagctacatggaggccacgtaagttgtagagtgaaattaagtgccctaacactcaaaggaacaagctataaaatttgtactgataagatgttctttgtgaaaaatcccacagatacaggacatgggacagtagtaatgcaagtaaaggtcagtaaaggagccccatgtcgtattccagtaattgtagcagatgatcttacggcagcaattaataaaggaatattagtaacagtaaatccaatagcatcgacaaacgatgatgaagtattaatagaggtaaatcccccatttggagattcttatataatagttggaagaggagatagtagactcacataccaatggcacaaagaagggtcatccataggaaaactttttacacaaacaatgaaaggcgtagaaagacttgcagtaatgggagatacagcatgggatttttctagcgcaggaggattctttacctcagttggtaaaggaatacatacagtgtttgggagtgcatttcaaggactttttggaggactaaactggataacaaaggtaataatgggagcagtactaatatgggtgggcataaacacaaggaatatgacaatgtcaatgagtatgattttagtgggtgtgataatgatgtttttaagcctaggtgtaggtgcagatcaaggatgtgcaataaatttcggaaag

SEQ ID NO: 890 - RNA, 2091 nt, synthetic construct
  misc_feature 1..2091: note = derived and/or modified CDS sequence (opt6) from YFV__DQ100292__X-SS-prME-XX
  source 1..2091: mol_type = other RNA
atgaggggactaagtagtagaaaaagaagatcacatgatgtactaactgtacaatttttaatattaggaatgttattaatgacaggaggggtaacattagtaaggaaaaatagatggcttttactaaacgtcacaagcgaggaccttggaaaaacattctcagtaggaactggcaattgtactacaaatatattagaagctaaatactggtgcccagattctatggaatataattgcccaaatctatcacccagagaggaacctgacgacatagactgttggtgctatggagtagaaaacgttagagtagcatatggaaaatgtgactccgcgggtagaagcagaagaagtagacgagcaatagacttacctacacatgaaaatcatggattaaaaacaagacaggaaaaatggatgacaggacgaatgggagaaagacagctacagaaaatagaaaggtggttcgtaagaaatccatttttcgcagttacagccttaacaattgcatatttagtaggaagcaacatgacacaaagagtcgtaatcgcactacttgtattagcagtaggacctgcatatagcgcacactgtataggaataacagatcgagactttatagaaggcgttcatggtggaacatgggttagtgccactttagaacaagacaaatgcgttacagtaatggcaccggacaaaccttcattagacatcagtctagaaacggtagcaatagatcgacctgcagaagcaagaaaagtatgttataacgctgtcttaactcacgtaaaaatcaacgacaaatgtccttcaacgggagaagcgcacttagcagaagaaaatgaaggagataatgcgtgtaaaaggacatattcagatagaggatggggaaatggttgtggattattcggaaagggatccatcgtagcatgcgcgaaatttacctgtgccaaaagtatgagtttatttgaagttgatcaaacaaagatacaatatgtaatcagagcacaattacatgttggagctaaacaagaaaattggaatacagatataaaaacattaaaatttgatgcattatcaggatcacaagaagtcgagtttataggatatggtaaagcaacattagaatgtcaagtacaaacagcggtagatttcggaaatagctatatagcagaaatggagacagaatcttggattgtggacagacaatgggcacaagacttaacattaccatggcaaagtggatcaggaggagtatggagagaaatgcaccatttagtagaatttgaaccaccacatgcagcaaccataagagtattagcactaggaaaccaggaaggctcactcaaaactgctttaactggagcgatgagggtaaccaaagatacaaatgataataacttatataaattacacggcggacatgtaagctgtagggtaaaactatccgcactgacgttaaaaggaacaagctataaaatatgcactgacaaaatgtttttcgttaaaaatccaacagatacaggccatggaactgtagtaatgcaagtaaaagtaccaaaaggagcaccatgtagaatcccagtaatagtagcagatgatcttacagcagcagtcaataaaggtatattagtaacagtgaaccctatagcaagtacaaatgatgacgaagtactaatagaagtaaacccaccctttggagattcctatataatcgtaggaagaggcgattcaagattgacttaccaatggcacaaagaaggaagtagcattggtaaactgtttacacaaacaatgaagggtgtagaaagattggcagtaatgggagatacagcatgggatttttcatcagcgggaggatttttcactagcgtaggtaaaggtatacacacagtatttggtagtgcatttcagggattatttggaggcttaaattggataacaaaagtaataatgggggcagtattaatatgggtaggtataaatacaagaaatatgacaatgagtatgagtatgatattagtaggggtaataatgatgtttttaagtttaggagttggtgcggatcaaggatgcgcaataaactttggaaaa

SEQ ID NO: 891 - RNA, 2091 nt, synthetic construct
  misc_feature 1..2091: note = derived and/or modified CDS sequence (opt6) from YFV__DQ118157__X-SS-prME-XX
  source 1..2091: mol_type = other RNA
atgagaggtctatctagcaggaaaagaaggagtcacgacgtattaacagtacagttcctaatacttggaatgttattaatgacaggaggagttaccttagtgaggaaaaatcgatggttattattaaatgttacaagtgaagacttaggtaagactttttctgtgggaactggcaattgtacaacaaatatactagaggcgaaatattggtgcccagatagtatggaatacaattgcccaaacctatcacctagagaggaaccagatgatatcgactgttggtgctatggagtagaaaatgtaagagtggcatatggaaaatgtgattcagcgggaagaagtcgccgaagcaggagagcaatagatctccccacacacgaaaatcatggacttaaaacaagacaagaaaaatggatgacaggcagaatgggagaaagacagttacagaaaatagaaaggtggtttgtaagaaaccctttctttgctgtaactgcattaactatagcatatttagtaggaagcaatatgactcaaagagtagtaatagcattgttagttttagcggtgggacctgcatatagtgctcattgtattggaatcaccgatagagactttatagagggagttcatggaggaacatgggttagcgcaacactagaacaagataaatgtgtgacagtaatggcacccgataaaccatcactggatatttcactagaaactgtagcaatagaccgaccagcagaagttagaaaagtatgttataacgcagtactaacacatgtaaaaatcaatgataaatgtccaagtaccggagaagctcatttagcagaagaaaatgaaggagataatgcatgcaagagaacatatagtgatagaggttggggaaatggatgtggtctatttggaaaaggatctatagtggcctgcgcaaaatttacatgtgcaaaaagtatgagtttgtttgaagttgatcaaactaaaatacaatatgttataagagcacaattacatgttggagctaaacaagagaactggaataccgatataaaaacactaaaatttgacgctctaagtggttcacaagaagtagaatttataggttacggaaaagctacactagaatgtcaagtgcaaacagcagtagacttcggaaactcgtacatagctgaaatggaaactgagtcatggattgtagatcgacaatgggcacaagacctaacattaccatggcaaagcggctcaggaggcgtctggagggaaatgcatcacttagttgaatttgaaccaccgcacgcagctacaataagggtattagcattaggaaaccaagaaggttctctaaaaacggcattaacaggcgcaatgagagtaacaaaagatacgaatgataataacctctataaactacatggaggtcatgtaagttgtagagtgaaattaagcgcattgacactaaaaggaacaagctataaaatatgtacagataaaatgttctttgttaaaaatccaacagacacaggtcatggaacagtagtaatgcaagtaaaggtatcaaaaggagcgccatgtaggattccagtaattgtagcagatgatttaaccgcagctataaataagggaattttggtaacagttaatccaatagcatcaacaaatgatgatgaagtattaatagaagttaatccaccatttggagacagctatataatagtaggaagaggtgattcaagactaacgtatcaatggcataaagaaggatcatcaataggaaaattgttcactcagacaatgaaaggagtagaaagattagctgtaatgggagatacagcatgggactttagtagcgctggtggattctttaccagtgttggtaaaggaatacacactgtttttggatcagcatttcaaggattgtttggaggtctaaactggataacaaaggtaattatgggagcagtattaatatgggtgggaataaatacgaggaatatgacaatgagtatgagcatgattttagtaggagtaattatgatgtttttaagcctaggcgtcggtgcagatcaaggatgtgcaataaacttcggaaaa

SEQ ID NO: 892 - RNA, 2091 nt, synthetic construct
  misc_feature 1..2091: note = derived and/or modified CDS sequence (opt6) from YFV__DQ235229__X-SS-prME-XX
  source 1..2091: mol_type = other RNA
atgataggattaagtagtagaaaacgtagaagtaatgaaatggcaatgatgcctttgctaattttaagtatggtaatactagccggaggtgtaactctagtaaggaaaaacagatggctactactaaatgtaacagcagaagatttaggtaaaacattctctttggggacgggaaactgtacaactaacatactagaagcaaaatattggtgcccagattcaatggaatataattgccccaacttaagtccaagagaagaaccagacgacatcgattgctggtgctatggagtagaaaatgtgagagtagcctatgggaggtgtgatgcagttggtagatccaaaagaagccggagagctatagatctgcctacacacgaaaatcatgggctaaaaacaagacaagaaaaatggatggccggaagaatgggagaaagacaattgcagaaaatagaaagatggctagtaagaaatcccttctttgcgataacggcgctggcgatagcttatttagtaggaaataatatgacacaacgtgtcgttatagcattattagtacttgcagtaggaccagcgtattcagcacactgtataggaattacagatagagattttattgaaggtgtacatggaggtacatgggtaagtgcaacgttagaacaaggaaaatgcgtaacagtgatggcaccggataagccaagtttagatatcagcttacaaacagtagcaatagatggaccagcagaagcacgcaaagtatgttattcagcagtactaacccatgtaaaaataaatgacaaatgtccttcaacaggagaagctcatttggctgaagaaaatgatggagacaacgcttgcaaaagaacatattctgatcgtggatggggaaatggatgtggactatttggaaaaggaagtatagtagcatgtgcaaagtttacatgcgctaaaagtatgagtttattcgaagtagatcaaacaaaaatacaatacgtaataagagcacaactacacgtaggagcaaaacaagaaaattggaacacagatataaaaacattaaaattcgatgctttaagtggaagtcaagaagcagagttcacaggatacgggaaagcaacattagaatgtcaagtacagacagcggttgattttggaaatagctatatagcagaaatggaaaaagatagttggatagtagatagacaatgggctcaagatctaacactgccatggcaaagtgggagtggcggtatatggagagaaatgcatcatctagttgaatttgaaccaccacatgcagcaacaataagagtactagccctgggcaaccaagaaggaagtctaaaaacagcactaacaggcgctatgcgagtaactaaagatgaaaatgataataatctatacaaattacatggaggtcatgttagttgtagagtgaaattatcagcactaacattaaaaggaacaagctacaaaatgtgtacagacaaaatgagctttgtcaaaaatccaacagatacgggacatggaacagttgtaatgcaagtaaaagtacctaaaggagccccttgtaagattccagtaatagtagctgatgatttaacagcagctgtaaataaaggaattttagttactgtcaatccaatagcatctacaaatgatgatgaagttttgatcgaagtaaatcccccatttggcgatagctacataatagtaggaactggtgacagtaggttaacatatcaatggcataaagaaggatcaagtataggaaaactattcacgcaaacaatgaaaggagcggaaagactagcagttatgggagacgcagcttgggatttttcatcagccggagggttctttacatcagtaggtaaaggaatacatacagtatttggaagcgcgtttcaaggattgtttggtgggttatcatggataacaaaagtaataatgggggcagtattaatatgggtaggaataaacacgagaaacatgacgatgagcatgagtatgattctagtaggggtaataatgatgtttttatctctaggagtaggagcagaccaaggatgtgctgtgaattttggaaaa

SEQ ID NO: 893 - RNA, 2088 nt, synthetic construct
  misc_feature 1..2088: note = derived and/or modified CDS sequence (opt6) from YFV__DQ322633__X-SS-prME-XX
  source 1..2088: mol_type = other RNA
atggggttatcaagtagaaaaaggagaagtcacgatgtattaacagtgcaatttctaatattaggaatgttactaatgacaggaggcgtaacattagtaaggaaaaacagatggttattactgaatgtaacatcagaagacctgggaaaaacgttttcagtaggaacaggaaattgcacaacaaatatacttgaagctaaatattggtgtcctgatagtatggaatacaactgcccaaatttatcaccaagagaagaaccggacgacatagattgttggtgttacggtgtagaaaatgtaagagtagcttatgggaaatgtgatagtgccggaagaagtagaagaagcagaagggctattgacttaccaacccatgaaaaccatggactaaaaacaagacaagaaaaatggatgaccgggagaatgggtgaaagacaactacagaaaatagaaaggtggtttgtaagaaatccattctttgcagtaacagcattaacaatagcatatctagtaggctctaatatgacacaaagggtcgtgatagcactgctagttttagcagtaggaccagcatatagtgcgcattgtataggaataacggatagagactttatagaaggagtacatggaggaacatgggtaagcgctacactagaacaagataaatgtgtaaccgtaatggcacctgataagccaagtctggatatatcattagaaacagttgcaattgatagacccgcagaagtaagaaaagtgtgttataacgcggttcttacacatgtaaaaataaatgataaatgtccaagcaccggagaagcacatctagcagaagaaaatgaaggggacaatgcctgtaaaagaacatattcagacagaggatggggaaacggatgtggattatttggtaaaggaagtatagtagcatgtgcaaaattcacttgtgcaaaaagtatgtcactatttgaagtagatcaaaccaagatacaatatgtaataagagcacaactccatgtaggggcaaaacaagaaaattggaacacagatataaaaactctaaaatttgatgcattatcaggtagtcaagaagtggaatttataggatacggaaaggcaacattagaatgccaggtacagactgcagtagatttcggaaatagttacatagcagaaatggaaacggaatcatggatagtagatagacagtgggcacaggacctaacattaccttggcaaagtggctcaggtggagtatggagagagatgcaccatttagtcgaatttgaaccgcctcacgcagcaacgattagagtattggcactaggaaatcaagaaggaagtctcaaaacagcgttaacgggagcaatgcgagtaaccaaagacacaaatgataataacttgtataaacttcatggaggacatgtaagttgcagagtaaaattatctgcactaactttaaagggaacatcttataaaatatgtacagataaaatgttctttgtgaaaaacccaacagatacgggacacggaactgtagtaatgcaagtcaaggtatcaaaaggagcgccatgtagaataccagtaatagtagcagatgatttaaccgcggcaataaataaaggaattttagtaaccgtaaacccgatagcaagcacaaacgatgacgaagtgttaattgaagtaaatccaccttttggagatagctatataatagtaggaaggggtgattcaagacttacatatcagtggcataaagagggaagctcaatcggaaaactattcactcaaacgatgaaaggagttgaaaggttagcagtaatgggagatacagcctgggattttagtagcgcaggaggcttctttactagcgtaggaaaaggaatacatacagtgtttggaagtgcgtttcaaggattatttggaggattaaactggataactaaggttattatgggcgcagttttaatatgggtagggataaatactagaaatatgacaatgagtatgagtatgattttagtaggggtaataatgatgttcttaagcctcggtgttggagcagatcaaggatgtgcaatcaatttcggtaaa

SEQ ID NO: 894 - RNA, 2067 nt, synthetic construct
  misc_feature 1..2067: note = derived and/or modified CDS sequence (opt6) from YFV__DQ322634__X-SS-prME-XX
  source 1..2067: mol_type = other RNA
atgagatcacatgatgttttaacggtacaattcctaatattaggaatgctgttaatgacgggaggtgtaacattagttcgtaaaaatagatggctcttattaaatgtaacaagtgaagatttaggaaaaaccttctctgtaggaacaggaaattgtacaacaaatatactcgaagctaaatattggtgtcctgactcaatggaatataattgcccaaacctatcgccaagagaagaaccagatgacattgactgttggtgttatggagttgaaaatgtaagagtagcatacggaaaatgtgacagtgctggaagatccagaagatcaaggagagccatagatctaccaactcacgaaaatcatggtctaaaaacaagacaagaaaaatggatgacagggagaatgggagaacgacaattacagaaaatagaacgatggtttgttagaaatcccttctttgcagtgacagcattaacaatcgcatacctagtaggtagcaacatgactcaaagagtagtaatagccttattagttttagcagtaggaccggcttatagtgcacactgtataggaataaccgatagagattttatagaaggagtacacggcggaacatgggtttccgcaacattagagcaagataaatgcgtcacagtaatggcaccagataaaccttcactagatattagtctagaaacagtagctatagataggcctgctgaagttagaaaagtctgttataacgcggtattgacccacgtaaaaataaatgataaatgcccatcaacaggagaagcgcacttagcagaagaaaacgaaggagataacgcatgtaaaagaacatattcagacagaggctggggtaatggttgcggattattcggaaaaggatcaatagttgcatgtgcaaaatttacatgtgcaaagtcaatgagcttatttgaagtagatcaaacaaaaattcaatatgtcataagagcgcaattacatgtaggtgcaaagcaagaaaattggaatacagatataaaaactttaaaatttgatgccttaagtggttcgcaagaagtagaatttataggttacggaaaggctacactagaatgtcaagtgcaaaccgctgtagattttggaaattcatatatagctgaaatggaaaccgaaagttggatagtagatagacaatgggcccaagacttaactctaccttggcaatcaggatcaggcggagtatggagagaaatgcatcatctagtagaatttgagccgccacatgcagcaacaataagggtcttggcattaggaaaccaagaaggatcactaaaaactgcattaactggagcaatgagagtcacgaaagatactaacgataataacttatataagttacatggaggtcatgtatcttgtcgcgtaaaactcagtgcgctaacattaaaaggtacttcatacaaaatatgtacagataaaatgttctttgtcaaaaacccaacagacacaggacacggaactgtagtaatgcaagttaaagttagtaaaggtgcaccatgtagaataccagtaattgtagcagatgatttaacagcagcaataaataaaggaatattagtaacagtaaaccctatagcatctacaaatgatgatgaagtattaatagaagtaaacccaccatttggagattcttatataatagtaggccgaggagattcgagattaacttaccaatggcacaaagaaggatcaagtattggaaaattatttacacaaacaatgaaaggagtagaacgtctagccgtaatgggggatacagcatgggactttagcagtgcaggaggattctttacgtcagtaggaaaaggaatacacacggtttttggatctgcatttcaaggactttttggaggtctaaactggatcaccaaagtaataatgggagcagttttaatctgggtaggaataaacaccagaaacatgacaatgtctatgagtatgatattagttggagtaataatgatgtttcttagcttaggagtaggggcagatcaaggttgcgcaattaactttggaaaa

SEQ ID NO: 895 - RNA, 2061 nt, synthetic construct
  misc_feature 1..2061: note = derived and/or modified CDS sequence (opt6) from YFV__DQ322642__X-SS-prME-XX
  source 1..2061: mol_type = other RNA
atgcgaggtttatcaagtaggaaacgtcgatcacatgatgtattaactgtacaatttctaatattaggaatgctattgatgacaggaggcgtaacattagtaaggaaaaacagatggctactacttaatgtaacaagcgaagacctaggaaaaacctttagcgttggaacaggaaattgtacaacaaatatattagaagctaaatattggtgtccagacagtatggaatataactgcccaaatctaagtccacgtgaagaacccgatgatatagactgctggtgttatggagtagaaaatgtaagagtagcatatggaaagtgtgattctgcaggaagatccagaagatcaagaagggccatagatttaccaacacatgaaaatcatggtctaaaaactcgacaagaaaaatggatgacaggaagaatgggcgaacggcaactacagaaaattgaaagatggtttgttagaaacccatttttcgcagttacagcattaacaatagcgtatctagtcggttcaaatatgacacaaagagttgtcatagcattgctagtattagctgtcggaccagcatatagtgcacactgcataggaataacagatagagattttattgaaggagtacatggaggaacatgggtgagtgcaactttagaacaagataaatgcgtaacagtaatggctcccgacaaaccatcgttagatataagtttagaaacagtagctatagacagaccggcagaagttagaaaagtatgttacaatgcagttttaacacatgtaaaaataaacgacaaatgccccagtacaggggaagcacatctagcagaagaaaatgagggcgacaacgcatgtaaaagaacttattcagatagaggttggggaaatggatgtggactatttggaaaaggctcaatagtagcgtgtgctaaatttacatgtgcaaaatctatgtcactatttgaagttgatcaaacaaaaatacaatatgtaataagagcgcagctccatgtaggagctaaacaagaaaattggaatacagatataaaaactttaaaatttgatgcattaagtggatcacaagaagtagaatttataggatacggaaaagcaacactagaatgtcaagtacaaacagcagtagattttggaaattcatatatcgcagaaatggaaactgaaagttggattgtagatagacaatgggcacaagatttgacgttaccgtggcaaagtggtagtggaggagtatggagagaaatgcaccacttagtagagtttgaaccacctcacgccgcaacaataagagtactagctttgggtaatcaagaaggaagtttaaaaacagccttaacaggcgcaatgagagtcacgaaagacaccaatgataataacttatataaattacacggaggacatgtctcatgtcgtgttaagttaagcgcactaacattaaaaggtacaagttacaaaatctgtacagataaaatgttctttgtcaagaacccaactgatacaggacatggaacagtcgtaatgcaggtaaaagtttcaaaaggtgccccatgtagaataccagtaattgtagcggatgatttaacagcggcaataaataaaggtattctggtcaccgttaacccaatagcgtcaacaaatgatgatgaagtattaatagaagtgaatccaccatttggagattcatatataatagtgggaagaggagatagtagactaacctatcaatggcataaagaaggaagttcaataggtaaactatttacgcaaacaatgaaaggagttgaacgattggcagtaatgggagatacagcatgggatttctcttccgcaggaggattctttacgtcagtaggaaaaggcattcacacagtatttggatcagcatttcaaggattgtttggtggattaaattggataaccaaagtaataatgggcgcagtattaatatgggtaggaataaacaccagaaatatgacaatgtcaatgtctatgatacttgtaggggtaataatgatgtttttaagtttaggcgtaggtgca

SEQ ID NO: 896 - RNA, 2091 nt, synthetic construct
  misc_feature 1..2091: note = derived and/or modified CDS sequence (opt6) from YFV__GQ379162__X-SS-prME-XX
  source 1..2091: mol_type = other RNA
atgagaggtctaagtagtagaaaaagaagatcccacgacgtactaacagtacaatttttaattctaggaatgttactaatgacaggaggagttactttagtaaggaaaaatagatggttgttattaaatgtaacaagtgaagatttgggaaaaacatttagtgtaggaacaggaaactgtacgacaaatattctagaagcaaaatactggtgtccagactctatggaatataattgtcccaatttatcaccaagagaggaacctgatgatatagattgttggtgttatggtgtagaaaatgtaagagtagcatatggaaaatgtgactcagcaggaagaagtagaagaagtagacgagcaattgatctccccacacacgaaaatcatggacttaaaacaagacaagaaaaatggatgacaggacgaatgggagaaagacaattacaaaagattgaacgatggtttgttagaaacccattctttgcagtaacagcactaacaatagcatatctagtaggaagtaatatgacacaaagagtagtaatagctttattagttttggcagtaggaccagcatatagcgcacactgcatagggattacagatcgagactttatagaaggcgtacacggtggtacttgggtttcagcaacattagaacaagacaagtgtgttacggtaatggcacctgataaaccatcattagatatatcattagaaacagtagctatcgaccgtccagcagaagcaagaaaagtttgttacaacgcagtcctcacacacgtgaaaataaatgacaaatgcccgagtacaggtgaagctcacctagcagaagagaacgaaggagacaacgcttgtaagcgcacgtatagtgatcgaggatggggaaacggctgtggactatttggaaaaggaagtatagtagcttgtgcaaagtttacatgtgctaagagtatgagtctatttgaagtagaccaaacaaaaatacaatacgttattagagcacaattacatgtaggtgctaaacaagaaaattggaatacatcaattaaaacactaaaatttgatgcattaagcggttcacaagaagtagaatttattggctatggcaaggctacattagaatgccaagtccaaacagcagtcgattttggaaacagttacatagctgaaatggaaactgaaagttggattgttgatcgccaatgggcacaagacttaacattgccctggcaatcaggatcaggcggggtctggagggagatgcatcatttagttgaatttgaacccccacatgcagcaactataagagtactagctttaggtaatcaagaaggatcactcaaaacagcactaacaggagcaatgagagtgacgaaagacacaaatgataataatttgtataaacttcacggaggccacgttagttgtagagtaaaactaagtgctctgacgctaaaaggtacttcatataaaatatgtactgataagatgtttttcgtgaaaaacccgacagatacaggacacggaacagtagtaatgcaagtaaaagtcccaaaaggcgctccgtgtagaataccagttatagtcgctgacgatttaacagcggcaataaacaaaggaatcctagttacagtaaatcccattgcaagtacaaacgatgatgaagtattaatagaagtaaatcctccattcggagatagttatataatagtaggaagaggtgattcgagattaacttatcaatggcataaagaaggatcatcgattggaaaactatttactcaaacaatgaagggtgtcgaaagactagcagtaatgggagatgtagcttgggatttttcaagcgcgggaggattctttacaagcgtaggaaaaggcattcatacagtatttggatcagcatttcaaggattattcggaggattaaactggataacaaaagtaataatgggagcagtactaatatgggtagggatcaatacacgaaacatgacaatgagcatgagtatgatattagtaggagtaataatgatgtttttaagcctaggcgtaggtgcggaccagggatgtgctataaactttggaaaa

SEQ ID NO: 897 - RNA, 2085 nt, synthetic construct
  misc_feature 1..2085: note = derived and/or modified CDS sequence (opt6) from YFV__DQ859065__X-SS-prME-XX
  source 1..2085: mol_type = other RNA
atgttaaaaggcgtatccggaaggaagaaaagaagaagcgttgaagcaacagggttcgtatcaacactactattcggaatagtactaacagcttcagtaagcagacatgcacatcatacgctattaaatgtaacaaaagaagatacaaaccaaatattaacattaaggaatggaaactgtacagtagtaagtatggacgttggttcctggtgtgacgataatgtagaatatgactgcgtaactctacaagacaatgaagaacctgacgacgtagattgttggtgttacaaagtaaatggagtaagggtaacatatggaaaatgcagagaaggaaataccccgagacgatcaaaaagagctgtcgtaataacagcacatttagatcaaggactaaccacaaagaaagaaacatggttaggtagtagtcattttgaaacacaaatacagaaaatagaaaaatggataatacgaaatccaacatatgcaatagcggccataataatggcatggtatattggcaattcaacaaaacaaagagtagtactattattacttacccttgcactagggccagcatacgcaacacactgtgttggaattgcaaaaagagattttgtacaaggagtacaaggaacaacatgggtaaacgtagttatggaacaaggagcttgtgtcacaatagtcacagaaggaaaacctagtgtagacgtatggatggaaggtattacattttcatcaccaactatggtaagaagaataagtcatactgctacaatttcagatacaaaaatatcatcagcttgcccaagtacaggggaagcaaaattagatgaagaacacgataaaacatttgaatgtaaacgaacctattccgatagaggttggggaaatggttgcggactctttggtaaaggatctatagtagcatgtgcaaaatttacaagtacaggacatatggacgtatatgaaatggatatgaccaaagtagaatatacaataaaaacccaagtgcattcaggcgcaaaaagcgatgatacaaccggtgtaaaagaaataaaattcacaccagtatcaggaacacaaacagtagagttcccagggtatggcaatttaggattagaatgtatagtacagtcagacatagatttcacaactcattatttagtagtattagggacagatgcatggttagtccataaagcatgggtagaagacgtaactcttccatggaaacatgaaggtgctgcgtcatggagagacaaacaatatttagtagaatttggagaacctcatgcagccacaataaaagtattagtacttggaagtcaagaaggagcattgagaacggcattagcgggtgcaatgatggtcactcatgattcaagtgccaaaacctttaaactacacggaggtcatgtaacatgcaaagcaaaacttaatgatttagtcattaaaggaacaacatacacaaattgcagaggaggactaagtttcgttaaaacaccaacagatactggacatggcactgtagttatgcaggtaaaagtatcaagaaatgcaccatgtcgattaactgtaattgcagccgacgatgcttcaggacatgtaaatagaggaaccctagtaacatcaaatccaatagcaaactctaataatgatgaagtattggtagaagtaaaccctccatacggtagttcatatttaatagtaggcacaggtgatgacaaattggtataccagtggaagaaaagcggatcatcaatagggaaactatttagtgaaaccgtaaaaggagcacagagaatggcaatagtagggtcatcaagctgggattttagtagcgcaggaggatttttctcaagcgtaggaaaagccctacatacagttttcggaacagcatttcaaggtatatttggtggcctatcatggataacacgagtcttaatcggagtacttttaatatggcttggtttaaattcaagaaatggaatggcaacgacggtcatgatgataactggttttgtaatactattcctatcattaggtgtaggagcagagatcggatgcagtgtaaattggggccaa

SEQ ID NO: 898 - RNA, 2091 nt, synthetic construct
  misc_feature 1..2091: note = derived and/or modified CDS sequence (opt6) from YFV__KU921608__X-SS-prME-XX
  source 1..2091: mol_type = other RNA
atgagaggattagcaagccggaaaagaagaagcaacgaaatggcattatttccattgttattactaggacttttagcattaagtgggggagtaaccctagtcagaaagaatagatggttattattgaacgtaacggctgaagacttgggaaaaaccttctcggttggaacaggaaactgcacaacaaatatattagaagctaaatattggtgtccagattcaatggaatataactgtccaaacctaagcccccgagaagaaccagacgatattgattgctggtgctacggagttgaaaatgtaagagtagcatatgggagatgcgatgctgtaggaagatcaaaaagaagcagacgagcaattgatctaccaacacatgaaaatcatggtttaaaaactagacaagaaaaatggatgacaggacgaatgggagaaagacaattacaaaagatagaaagatggcttgttagaaatccattcttcgcagtaacagcactagcaatcgcttatctcgtaggaaataatacaactcaaagagtcgtaatagcactattagtactagcggtaggtccagcatatagcgctcattgcataggtattacagatcgagattttatagaaggagtgcacggaggaacttgggtttctgccacacttgaacaagacaaatgcgtcacagtaatggcaccagataaaccatcattagatatatcactccagacagtagctatagatggcccagccgaagcacgaaaagtctgttattcagcagtccttacacatgtaaaaataaacgataaatgtccaagtacaggagaagctcatttagcagaagaaaacgatggagataatgcatgtaaaagaacatatagcgacagagggtggggaaatggttgtggtctatttggtaaaggtagtatagtcgcatgcgcaaagttcacatgcgcaaaatcaatgtcattatttgaagtagatcaaacaaaaatacaatacgtaataagagcacaactacatgtaggagctaaacaagaaaactggaacaccgatattaaaacattaaaattcgacgcattatctggatcacaagaggctgaatttacaggatatggaaaggcaacattagaatgtcaagtacaaacagcagtagactttggaaactcatatatcgcggaaatggaaaaggacagctggatagtagacagacaatgggcacaagatttaacactaccatggcaatcagggtctggaggaatatggagagaaatgcatcacctcgtagaatttgaacctccacacgcagcaacaatacgtgtattagcattaggaaaccaagaaggatcactaaaaactgccttaacaggagcaatgagagtaacaaaagatgaaaacgataacaatttatataaacttcatggaggtcatgtatcatgccgagtaaaattaagcgcacttactttaaaaggaacaagttataaaatgtgcacagacaaaatgtcatttgttaaaaatccaacagatactggccatggaacagtagtaatgcaggtaaaagttccaaagggagcaccttgcaaaataccagtaatagttgcagatgatttaacagcagcagtcaataaaggtatcctagtaacagtaaaccctatagcaagtactaacgacgatgaagtcttaatagaagtaaatcccccttttggagattcgtatataatagtaggaacaggagacagtcgcttgacatatcaatggcataaagaaggtagcagtataggaaaactatttactcaaacaatgaagggagcagaaagattagcagtaatgggagatgcggcatgggactttagtagcgcaggaggcttctttactagcgttggtaaaggaatacacacagtttttggatcagcatttcaaggattatttggaggattatcatggatcactaaggttatcatgggagcagttctaatatgggtaggcataaatacaagaaatatgacaatgagtatgagtatgattctagtaggagtaataatgatgtttctgtcattaggagtaggtgcagaccaaggatgcgcagtaaatttcggaaaa

SEQ ID NO: 899 - RNA, 2091 nt, synthetic construct
  misc_feature 1..2091: note = derived and/or modified CDS sequence (opt6) from YFV__KX010994__X-SS-prME-XX
  source 1..2091: mol_type = other RNA
atgagaggactatcttctagaaaaagacgatcaaatgaaatggcaatgtttccactattattattaggattgttggcactttcaggaggagttacattagttagaaagaatcgatggttattgttaaatgtgacagcagaggacttaggaaaaacattcagtgtaggaacaggaaattgtacaactaacatcttagaagcaaaatactggtgtcccgactctatggaatataactgtccaaatctaagtccgagagaagaacccgatgatatagactgttggtgttatggagtcgaaaatgtaagagtagcgtatgggagatgtgatgctgtcggaagaagtaaaagaagtaggagagccatagatttaccaacacatgaaaatcatggcttaaaaacaagacaagaaaagtggatgacaggaagaatgggagagagacaattacaaaagatagaaagatggttagttagaaacccattctttgcagtaacagcactagctatagcatatctggtaggaaataacacgacacaaagagtggtaattgcattattagtattagcagtgggacctgcatattctgcacattgtataggaataacagacagagactttatagaaggcgttcatggaggaacttgggtatcagcaactttggaacaagataaatgtgtaacagtcatggctccagacaaaccatcattagatataagtttacaaacggtagctatagatggaccagcagaagctaggaaagtatgctacagcgcagtactcacacatgtaaaaattaatgataaatgtccatctacaggagaagcacatctcgctgaagagaatgacggtgacaatgcatgtaagagaacatactcagatagaggatggggaaatggatgtggattattcggaaaaggaagtatagtggcgtgcgcaaagtttacttgcgcaaaaagtatgtcattatttgaagtagatcaaacaaaaatacaatatgtaataagagcacaactacacgttggagcaaaacaagaaaactggaatacagacattaagactttaaaatttgatgctttatccggatcacaagaagctgaatttacaggatacggaaaagctaccctagaatgccaggtacaaacggcagtcgactttggaaattcatacatagcagaaatggaaaaagatagctggatagtagatagacaatgggcacaagatctaacactgccatggcaatcaggctcaggaggaatatggagagaaatgcatcatttggttgaatttgaacctccacatgcagctacaataagagtactagcactaggaaatcaagaaggttcactaaagacagctttaacaggagcaatgcgtgttactaaagacgaaaacgataacaatctttataaactacatgggggtcacgtcagttgtagagttaaactaagtgcattaactctgaaaggaacgagctataaaatgtgtacggataaaatgagttttgttaaaaatccaacagatactggtcacggaacagtagtcatgcaagtgaaagtcccaaaaggggcaccatgcaaaatacctgtaatagttgctgatgatctaacagcagcggtaaacaaaggaatattagtaacagtaaacccaatagcaagtacaaacgatgacgaagttctaatagaagttaacccgccatttggagatagctatataattgtgggcactggagatagcagactaacataccaatggcacaaagaaggttcatcaataggaaaactttttacacaaacaatgaaaggagcagaaagactggctgttatgggtgatgcagcatgggatttttcatcagcaggaggattctttactagcgtcggaaaaggaatacataccgtttttggaagcgcattccagggtctatttggaggactatcctggataaccaaagtgatcatgggagcagtattgatatgggtaggcataaacactagaaatatgacaatgagtatgtcaatgatcctagtaggggtaataatgatgtttttaagtttaggagtaggtgctgatcaaggatgcgctgtaaattttggaaaa

SEQ ID NO: 900 - RNA, 2091 nt, synthetic construct
  misc_feature 1..2091: note = derived and/or modified CDS sequence (opt6) from YFV__KX027336__X-SS-prME-XX
  source 1..2091: mol_type = other RNA
atgagaggtcttgcaagtaggaagagaagatcaaacgaaatggcaatggtcccgcttcttttattaggtttattggccctaagtggaggagtgacattagtcagaaagaatcgatggttattactaaatgttactgcagaagatttaggaaaaacattctctgttgggacaggtaattgcacaacaaatatattagaagcgaaatattggtgtccagactcaatggaatataattgtcccaatctttcgccaagagaagaaccagatgatatagactgttggtgttatggagtagagaatgtaagagtagcatatggaagatgtgatgctgtaggtagaagcaaaagatcacgaagggctatagacttacctacacatgaaaaccatggactaaaaacaaggcaagaaaaatggatgacaggccgaatgggcgagagacaattacagaaaatagaaagatggctagtccgaaatccattctttgcagtaacagcgctggccatagcatatttagtaggaaacaatactacacaaagagtagtaatagccttattagtattagcagtgggaccagcgtactcagctcattgtatcggcattacagaccgagattttatagaaggcgttcacggaggaacatgggtaagcgcaacacttgaacaagataaatgcgtaacagtgatggcaccagataaacctagcttagatataagtttacaaactgtagccattgatggaccagcagaagccagaaaagtatgttacagtgcagtattaacacacgtcaaaattaacgacaaatgtccatcaacaggagaagcacacctcgccgaagaaaatgatggtgacaatgcatgtaaaagaacgtattcagacagaggatggggaaatggttgcggcttatttggaaaaggaagcattgtagcatgtgcaaaatttacgtgtgccaaatcaatgagcttatttgaagtagatcaaacaaaaatacaatacgtaatcagagcacaattacatgtaggcgctaaacaagaaaattggaatacagacataaagacactaaaatttgacgctctatcaggatcacaagaagcagagtttacaggttatggaaaagcaacactagaatgtcaagtacaaactgcagtagactttggcaattcatacatagcagaaatggaaaaagactcatggatagtagacagacaatgggctcaagacttaacattgccatggcaatcgggaagcggaggaatatggagggaaatgcaccatttagtagaatttgaaccaccacatgcagcaacgatccgagtattagcattgggaaatcaagaaggatcattaaaaacagcactaacaggtgcaatgagagtaacaaaagatgaaaacgacaacaacctatataaacttcatggtggacatgtatcatgtagagtgaaattgtcagctctgacgctgaaaggtacaagttacaaaatgtgcactgacaaaatgtcatttgttaaaaacccaacagatacaggacatggaaccgtagtcatgcaagttaaagtcccaaaaggtgcaccatgtaaaattccagttatagtagccgacgatttaacagcagctgtcaataaaggaatattagtcacagtaaatccaatagctagtacaaatgatgatgaagtacttatagaagtaaatccaccttttggagacagttatataatagtaggaacaggagatagtagactaacttaccaatggcataaagagggtagttcaattggaaaattatttacacaaacaatgaaaggagctgaaaggctagcagtcatgggagatgcagcatgggatttttcaagtgctggaggattctttactagcgttggaaaaggaatacatactgtatttggaagtgcattccaaggtttattcggaggtctaagctggatcacaaaggtaataatgggggcagtattgatttgggttggtattaatacacgaaatatgacaatgagcatgtcaatgatattagtaggtgtaataatgatgtttctgtcattaggcgtgggagcagaccagggatgtgcagtcaattttggaaaa

SEQ ID NO: 901 - RNA, 2091 nt, synthetic construct
  misc_feature 1..2091: note = derived and/or modified CDS sequence (opt6) from YFV__JX898868__X-SS-prME-XX
  source 1..2091: mol_type = other RNA
atgagaggactgtcatcaaggaaaagaagatcacatgatgctttagcagtacaatttctaattttgggaatgttactgatggcaggaggggtaacattagtaagaaagaaccgatggttacttctaaatgtaacaagtgaagacctgggtaaaacatttagtgtaggaactggtaactgcacaactaacatattagaagcaaaatactggtgcccagatagtatggaatataactgtccaaatttatcaccgagagaagaaccagacgacatagattgctggtgttacggagttgaaaatgtaagagtggcgtatggaaaatgcgattcagcaggaagatcaagaagaagcaggagagcaatagatctgcctacacatgaaaatcatggattaaaaacaagacaagaaaaatggatgacagggagaatgggtgaaagacaattacagaaaatagaaagatggttagtaagaaaccctttcttcgcagtaacagcattgaccatagcatatttagtaggatccaacatgatgcaacgtgttgtaatagcattgcttgtcttagcagtgggacctgcatatagtgctcactgtataggaataacagatagagatttcatagaaggagtacatggaggtacctgggttagcgctacattagaacaagataaatgtgtaacagtaatggcaccagataaaccatcattagatataagcctagaaacagtcgcaatagatggaccagcggaagcaagaaaagtatgctataatgcggtattaacccatgttaaaataaatgataaatgtccaagtacgggagaagcacatttagcagaagaaaatgaaggagataacgcttgtaaaagaacatattccgacaggggatggggtaacggatgcggattatttggaaaaggaagtattgtagcatgcgcaaaatttacatgtgcaaaaagtatgagtttatttgaggttgaccaaactaaaatacaatacgtaataagagcacaattacatgtaggcgccaaacaagaaaattggaatacagacataaaaacactgaaatttgatgctctaagcggaagtcaagaagcagagttcacaggatatggaaaagcaaccctagaatgccaagtacaaactgcagtagattttggtaacagctacatagcagaaatggaaaaagaaagctggatagtagatagacaatgggcacaagatttgacgttaccatggcaatcagggagcggtggagtatggcgagaaatgcaccatctagtagaatttgaaccaccacacgcagcaaccattcgggtattagcattaggaaaccaagaaggaagtttaaaaacggctttaacaggcgcaatgagagttacaaaagatacaaatgataataacttatataaactacacggcggacatgtatcatgtagagtaaaattaagcgcacttacactaaaagggacatcatacaaaatgtgcactgataaaatgtcatttgtgaaaaacccaacagatacaggacatggaacagtagtaatgcaagtaaaggtacctaaaggtgcaccctgcaaaataccagtaatagtggccgatgatttaacagcagctataaataaaggaatattagtaacagttaatcctattgcctcaacaaatgacgatgaggtactaattgaagtaaacccaccattcggagacagctatataattgtaggaacaggagattcaagattaacttatcaatggcataaagaaggaagttcaatagggaaattatttacccaaactatgaaaggcgcagaaagattagcagttatgggtgacgcagcgtgggattttagtagtgctggtggattcttcacatcagtaggaaaaggaatacatacagtcttcggatcagcatttcaaggcctatttggcggattaagttggataacaaaagtaataatgggtgcagttttaatatgggtaggaataaatacacgaaatatgacaatgagtatgtcaatgatattagtaggagtaataatgatgttcctaagtcttggagtgggagcagatcaaggctgcgcaataaacttcggtaaa

SEQ ID NO: 902 - RNA, 2091 nt, synthetic construct
  misc_feature 1..2091: note = derived and/or modified CDS sequence (opt6) from YFV__JX898869__X-SS-prME-XX
  source 1..2091: mol_type = other RNA
atgagggggttatcaagtagaaaaagacgaagccatgatgtactaactgtacaattcttaatattaggaatgcttttaatggccggtggagttacactcgtaagaaagaacagatggttactgttaaatgtcacgtcagaagatctcggaaaaacattctcagtaggcacaggaaattgtactacaaatatattagaagcaaaatattggtgccccgatagcatggaatataattgcccaaacttgtccccaagagaagaaccagatgatatagattgttggtgttatggagtagaaaatgtccgagtggcatatggaaaatgtgacagcgcagggagaagtagaagaagtagacgagcgatagatttaccaacacatgaaaaccatggcctaaaaacaagacaagaaaaatggatgactggaagaatgggagaaagacaacttcaaaagatagaaagatggttagttcgtaatcccttctttgcagttaccgcattaacaatagcatatttagtaggaagtaatatgacacaaagagtagtaatagctctattagtattagcagtaggaccagcatatagtgcacattgcataggaataacagacagagactttatagagggcgtacatggaggaacatgggtaagtgctacattagagcaagataaatgcgttacagttatggcacctgataaaccaagtttagatatatcactggagacagtcgcaatcgacgggccagcagaagctagaaaagtatgctataacgcagtgctgacacatgtaaaaatcaatgacaaatgtcctagtactggtgaggcacacctagcagaagaaaacgaaggtgataacgcatgtaaaagaacttattcagatagaggctgggggaatggatgcggattatttggaaaaggatcgatagttgcttgcgcaaaatttacatgcgcgaaaagcatgagtctatttgaagtagatcaaacaaaaatacaatatgttataagggcacaacttcacgtaggagcaaagcaagaaaattggaacacagatataaaaacattaaaatttgacgcattaagtggatcacaagaagcagagttcaccggatatggaaaagcgactttagaatgccaagtgcaaacagcagtagactttggaaatagctatatagcagaaatggaaaaagaaagttggatagtagataggcaatgggcacaagatttaacactaccatggcaatctggaagcggaggggtatggagagaaatgcatcatctagtagaatttgaaccaccacatgcagcaacaataagagtactagcattagggaatcaagaaggaagcctaaaaaccgccttaacaggagctatgagagtaacaaaagatacaaacgacaataacttatacaaactacatggtggacatgtatcatgccgagtaaaattatcagcactaacactcaaggggacttcgtataaaatgtgtacagacaagatgagctttgttaagaatccaacagatacaggacatggtacagtagtaatgcaagtcaaggtaccgaagggagcaccttgcaaaatacccgtaattgtagcagacgatttaacagcagcagtaaataaagggattttagtaacagttaacccaatagcatctacaaatgatgatgaagtgttaatagaagttaacccaccattcggagatagttatataatagttggaacaggtgactcgagacttacatatcaatggcacaaagaaggaagctcaataggaaaattatttacacaaacaatgaaaggagcagaaagactggcagtaatgggagatgcagcatgggatttctcatcagcagggggatttttcacatcaatcggaaagggtattcacactgtatttggatcagcgtttcaaggattatttggaggattatcatggataaccaaagttataatgggagcagtattaatttgggttggaataaatactaggaatatgactatgtcaatgagcatgatacttgtaggtgtaattatgatgtttttgagcttgggtgtaggagcagatcaaggatgtgctataaatttcggaaaa

SEQ ID NO: 903 - RNA, 2091 nt, synthetic construct
  misc_feature 1..2091: note = derived and/or modified CDS sequence (opt6) from YFV__JX898873__X-SS-prME-XX
  source 1..2091: mol_type = other RNA
atgagaggactttcaagtaggaagagaagatcacatgatgcattaacggtacaattattgatattagggatgatattaatggcaggaggtgtaacattagtaagaaagaatcgatggttacttctaaatgtaacaagtgaagatttaggtaaaacattttcagtgggtacgggtaactgtaccacaaatatattagaagcaaaatactggtgtccagattcgatggaatataattgtccaaacctaagtccacgggaagaaccagatgacatagattgctggtgttatggagttgaaaatgtgagagttgcatatggaaaatgtgatagcgctggaagaagtagaagatcaagacgagcaatagatctacctacacacgagaatcatggattaaaaactagacaagaaaaatggatgactggtagaatgggagaaagacagcttcagaaaatagaaagatggttagtaagaaatcctttctttgcggtaacagccctaacaattgcatatttagtaggttctaatatgacacaaagagtagttattgcactattagttttagcagtaggaccagcatattcggcacattgtataggaataactgatagagattttattgaaggtgtacatggtggcacttgggtatccgcaacattagaacaagataaatgtgtgacagtaatggcaccagataaaccatcattagacataagtctagaaaccgtagcaatagatggaccagccgaagcaagaaaagtatgttataatgcagtattaacccatgtaaaaataaatgataaatgtccttcaacaggagaagcacatctagcagaagaaaatgaaggagataatgcatgcaaaagaacttacagtgatagaggatggggaaatggctgtggactattcggaaaaggaagcatagtagcctgcgcaaaatttacatgtgccaaaagtatgagcttatttgaggtagatcaaacaaaaatacaatatgtgataagagcacaattacatgtcggagcaaaacaagaaaattggaacacagatatcaaaacactaaaatttgatgcactgagtggttcacaagaagcggagtttacaggatatggcaaggcaacgttagaatgtcaagtacaaacggcagtagattttggaaactcatacatagcagagatggagaaagaatcatggatagtggacagacaatgggcccaagatttaacattaccgtggcaaagtggatcaggaggtgtatggcgagaaatgcaccacttagtagaatttgaacctccacatgcagctacaataagagtattggcattaggcaatcaagaaggatcattgaaaacagcactaacaggagcaacaagggtaactaaagacacaaatgataataatttatataaattgcatggcggacacgtatcttgtagagtaaaattgtcagccttgacattaaaaggaacaagttataaaatgtgcacagataaaatgtcattcgttaaaaatccaactgatacaggacatgggacagtagtaatgcaagtaaaagtaccaaaaggagcaccgtgtaaaattccagtaatagttgcagatgatctgacagcagccattaataaaggaatattagtaaccgtaaatccaatagcaagtacaaatgatgatgaagtattaatagaagtgaatcctccatttggagactcatacataattgtaggtacaggggacagtcgactgacatatcaatggcacaaagaaggatccagcattggcaaattatttacacaaacaatgaaaggagcagaacgattagccgtaatgggagatgccgcatgggattttagttctgcaggaggattctttactagcgtagggaaaggaatacatactgtttttggctcagcatttcagggattatttggaggactaagttggataacaaaagtaatcatgggtgcagtgttaatatgggtaggaataaatacgaggaatatgacgatgagtatgtcaatgattctagtaggcgtaataatgatgtttttatccttaggggtaggagctgaccagggatgcgcaataaattttggcaaa

SEQ ID NO: 904 - RNA, 2091 nt, synthetic construct
  misc_feature 1..2091: note = derived and/or modified CDS sequence (opt6) from YFV__JX898874__X-SS-prME-XX
  source 1..2091: mol_type = other RNA
atgagaggattatcatcaagaaaaagaagatcacatgacgcactaactgtacaactattaattttaggaatgatattaatggcaggaggagtaacattagttagaaagaatagatggctattattaaacgtaacatcagaagatttgggaaaaacttttagtgtagggactggcaactgtacaacaaatatactagaagcaaaatattggtgtccagattcaatggaatataactgtccgaatctctcaccaagagaagaaccagatgatattgattgttggtgctacggagtagaaaatgtaagagtagcatacggtaaatgtgacagtgcaggtcgatccagacgaagtcgaagggcaatagacttgcctactcatgaaaatcatggactgaaaactagacaggagaaatggatgacaggaagaatgggagaacgacaattacagaaaatagagagatggttagttagaaatccgttctttgcagtaaccgcactgacaatcgcttacctagtaggttctaacatgacacaaagagtagtaatagcattattagttttggcagtgggaccagcatattcagcccattgcataggaataacagatagagattttatagaaggtgtacatggaggaacatgggtaagcgcaacattggaacaagataaatgtgtaacagtaatggcaccagacaaaccaagtcttgacattagcttagaaactgtagctatagatggaccagcagaagcaagaaaagtatgttataatgcagtattaactcacgtaaaaataaatgataaatgtccttcaacaggagaagcacatctggcagaagaaaatgaaggtgacaatgcgtgtaaaaggacatatagcgatagaggatggggtaatggatgtggactatttggaaaaggaagtatcgtagcatgtgcaaaattcacatgtgcaaaaagtatgtctctatttgaagtagatcaaactaaaatacaatatgtaatacgtgcacaattacatgtaggtgcaaaacaagaaaattggaacactgatataaaaacattaaaattcgatgcactatcaggtagtcaagaagcagaatttaccggttatggaaaagcaacattagaatgtcaggtccaaactgcggtagactttgggaacagttatatcgctgaaatggaaaaagaaagttggatagttgataggcaatgggcacaagatttaacattaccatggcaaagtggatcaggaggagtatggagagaaatgcaccatcttgtcgaatttgaacccccacacgcagcaacaataagagtattagctctaggtaatcaagaaggatcacttaaaacagcgttaactggagcaatgagagttactaaagatacgaatgataacaacctttataaattacatggaggacatgtaagttgtagagtcaaattaagtgcattaactttaaaaggtactagctataaaatgtgtacagataaaatgtcatttgttaaaaatccaacagacacaggtcatggaaccgtagtaatgcaagtgaaagtaccgaaaggcgcaccatgtaaaatcccagttattgtagcagatgatttaacagcggcaatcaataaaggaatcttagtcacagttaatccaatagcaagtacaaatgatgatgaagttttgattgaagtgaacccaccttttggcgacagctatataatagtaggtacaggggattcaagactaacttaccaatggcataaagaaggatcgtcaataggaaaattatttacacaaacaatgaaaggggccgaaagattagcggtaatgggagatgctgcttgggacttttcaagcgcgggaggtttcttcacgtctgtaggaaaaggaatacacacagtttttggaagcgcttttcaagggctgtttggaggattgagttggataactaaagtaataatgggagctgtattaatatgggtaggaataaatacaagaaacatgacaatgagtatgtcaatgatattagtaggagttataatgatgtttctgtcgttgggagttggtgcagaccaaggatgtgcaataaactttggaaaa

SEQ ID NO: 905 - RNA, 2091 nt, synthetic construct
  misc_feature 1..2091: note = derived and/or modified CDS sequence (opt6) from YFV__JX898875__X-SS-prME-XX
  source 1..2091: mol_type = other RNA
atgcgaggcttaagcagtagaaaaaggagatctcacgatgcgttaacagtacaattactaattttaggcatgatcttaatggcaggaggagttacgttggtacgaaagaatagatggctactactaaatgtaacaagtgaagatctaggaaaaacattctctgtaggaacaggaaattgcacaactaatatattagaagccaaatattggtgccccgattctatggagtataattgtccaaatttaagtccaagagaagaaccagatgatattgattgttggtgttacggagtggaaaacgtaagggtcgcttatggtaaatgtgactcagcaggaagaagccgaagatcacgaagggcaatagatttgccaacacatgaaaatcatggattaaaaacacgacaagaaaaatggatgacaggaagaatgggcgaaaggcaattacaaaagatagaaagatggcttgtaagaaatccattctttgctgtaacagcacttacaatagcttatttagtaggaagtaatatgacgcaaagagtagtaattgcactattagtattagccgtcggaccagcatactcagcacactgcataggcataacggacagagattttatagaaggagtacatggaggaacatgggtatcagcgactttagaacaagacaaatgtgtaacagtaatggcaccagacaaaccatcactagatatcagcctagaaacagtagcaatagacggtccagcagaagcacgaaaagtttgctataatgcagtacttacccacgtaaaaataaatgataaatgtccatcaacaggagaagcccacctagcagaagaaaacgaaggagataatgcatgcaaaagaacttatagcgatagaggatggggcaatggatgtggtttatttggcaaaggttcaatagtagcatgtgcaaaatttacatgtgcaaaatcaatgtcattatttgaagtagatcaaacaaaaattcaatatgtaataagagcacaattacacgtaggtgcaaaacaagaaaattggaataccgatataaaaaccctaaaatttgatgcactatcaggatcacaagaagcaaaatttacaggatacggaaaagcaaccctagagtgtcaagtacaaaccgccgttgattttggaaactcatatattgctgaaatggaaaaagaatcttggattgtagaccgacaatgggcacaagatcttacactaccatggcaaagtggaagtggcggcgtttggagagaaatgcaccatttagtagaatttgaaccaccacatgcggccactatacgagtattagcactaggtaaccaagaaggcagcttaaaaacagcattaaccggagcaatgagagttactaaagatacaaatgataataatttatacaaactacacggaggacacgtttcatgtagggttaaattaagtgcactaaccttaaaaggtacatcatataagatgtgtactgacaaaatgagtttcgtgaaaaatcctaccgatacaggacatggcaccgtagtaatgcaagttaaagtacctaaaggtgcaccttgtaaaataccagttatagttgcagatgatctaactgcagcaattaataagggtatattagtaaccgtaaatccgatagcaagcacaaatgacgacgaagttctaatagaagtaaacccaccatttggagattcctatataatagtcggaacaggtgactcaagactaacctatcaatggcacaaagaaggttcatcaataggaaaattattcacacaaactatgaagggagcagaaagattggcagtaatgggagacgctgcatgggatttttcaagcgcagggggtttctttacgtctgttggtaaaggaatacatacagtatttggaagtgcatttcaaggattatttggaggattatcgtggatcacaaaagtaataatgggtgcagtattaatctgggtagggattaatacacgaaacatgacaatgagtatgtcaatgattctagtaggtgtaattatgatgttcctatcccttggagtaggtgcagaccaaggttgcgcaataaactttggaaaa

SEQ ID NO: 906 - RNA, 2091 nt, synthetic construct
  misc_feature 1..2091: note = derived and/or modified CDS sequence (opt6) from YFV__JX949181__X-SS-prME-XX
  source 1..2091: mol_type = other RNA
atgagaggtctaagctcaaggaaacgtcgctcacatgacgtattgacagtacaatttctaatattaggtatgttattaatgacaggtggggtaacattagtaaggaaaaatagatggttactactaaatgtaacaagcgaagatttaggcaaaactttcagcgtaggcacgggcaattgtacaacaaacatattggaagcaaaatattggtgtccagatagtatggaatacaattgtcctaatttatcacctagggaggaaccagatgatatagattgttggtgctacggagtagaaaatgtcagagtagcatatggtaaatgcgacagtgccggaagaagtaggagatcaagaagggccatagacctaccaacacatgagaaccatggtttaaagacaagacaagaaaaatggatgacaggaagaatgggagaaagacaattgcagaaaatagaacgttggtttgtaagaaacccattctttgcagtcactgcacttacaattgcatatctagttggatcaaatatgacccaaagagtggtaatagcattattagtattagcagtaggaccagcatatagcgcacattgtataggaataactgacagggattttattgaaggagttcacggaggaacatgggtaagtgcaacactagaacaagacaaatgtgtaactgtgatggcacccgacaaaccaagtctcgatatatcattagaaacagtagccatagatagaccggcagaagtcagaaaagtgtgctataacgcagtattaactcatgtaaaaataaatgataagtgcccaagtacaggtgaggcacacttagccgaagaaaatgaaggagataatgcatgtaagagaacatacagcgatcgaggctggggaaatggatgtggactatttggtaaaggaagtatagtagcatgtgcgaaatttacatgtgcaaaaagcatgagtttatttgaagttgatcaaacaaaaatacaatatgtaatacgagcgcaattacacgtaggagcaaaacaagaaaattggactacagatataaagaccttgaagtttgacgctttaagtggatcacaagaagtagaatttattggctatggtaaagctacattagaatgtcaagtacaaacggcagttgactttggaaattcttacatagcagagatggaaacagaaagttggatagtagataggcaatgggcacaggacctaacattaccttggcaaagtggttctggtggagtttggagggaaatgcaccatttagtagaatttgaacctccacacgcagcaacaatcagggtattagcactaggcaatcaagaaggtagcttaaaaacagcattaacgggagcaatgagagttacaaaagatacgaatgataataacttatacaaacttcatggaggacatgtatcatgtagagtaaaactatccgcattaacattaaaaggcacatcatataaaatatgtactgataaaatgtttttcgttaaaaatcctacagatacgggacatggaacagtagtaatgcaagtaaaagtaagtaaaggagcaccatgcagaataccagtcattgtagcagatgatctaacagctgcaataaataaaggaatattagtcactgtaaacccaatagcatcaacaaacgacgatgaagtattaatagaagtgaacccaccatttggagatagttatataatagtgggtcgaggagactcacgtttaacataccaatggcacaaagaaggaagtagtataggaaaactatttacacaaacaatgaaaggagtagaaagattagcagtcatgggagatactgcatgggatttcagttctgctggcggtttctttacaagtgtaggaaaaggaatacacaccgtatttgggtcagcatttcaaggactattcggtggactaaactggattacaaaagttataatgggggtagtattaatttgggtcggtataaacacaagaaatatgacaatgagtatgagtatgattttagtaggtgttataatgatgtttttgagcttaggagtaggagcagatcaaggatgtgcgataaactttgggaag

SEQ ID NO: 907 - RNA, 2091 nt, synthetic construct
  misc_feature 1..2091: note = derived and/or modified CDS sequence (opt6) from YFV__AY968064__X-SS-prME-XX
  source 1..2091: mol_type = other RNA
atgagaggtttatcgtctagaaaaagacgcagtaatgaaatggctttattcccattattattattagggttattagcactatcaggaggagtaacattagtcagaaagaatagatggctattattaaatgtaacggcagaagatttaggaaaaacatttagtgtagggacaggtaattgtacgacaaacatactagaagcaaaatactggtgtcccgactcaatggaatataactgtccaaatttgtcaccaagagaagaaccagatgacatcgattgttggtgttatggtgtcgaaaacgtaagagtagcatatggtagatgtgacgcagtaggaagaagcaaaagatcaaggagagcaatagatttaccaacacacgaaaatcacggtcttaaaactagacaagaaaaatggatgacaggtagaatgggcgaaagacagctacagaaaatagaaagatggttagttagaaatccattctttgcagtaacagctttagcaatagcatatctagttggaaataacacaactcaaagggttgtaatagcactcttagtattagctgtaggaccagcctacagcgcgcattgtataggtataacagatcgagattttattgaaggagtacacggaggtacatgggtgtctgcaacactagaacaagataaatgcgtaacagtaatggcgcccgataaaccaagtctagatatatcactacaaactgtcgcaatagatggaccggcagaggctagaaaagtatgttattcagcagtattaactcatgtaaaaataaatgacaaatgcccaagtacgggagaagcacatctagctgaagaaaacgacggagataatgcgtgtaaaagaacatacagtgatagaggatggggtaatggatgcggattatttggaaaaggatcaatagtcgcatgcgctaaatttacctgcgcaaaatcaatgagtttattcgaagtggatcaaacaaaaattcaatatgttataagagcacaattacatgtcggagctaaacaagaaaattggaatactgatataaaaacactgaaatttgatgcactaagcggttctcaagaagcagaatttacaggatacggaaaagcaacattagaatgtcaagttcaaaccgctgtagattttggaaactcttatatagcagaaatggaaaaagacagctggatcgtagatagacaatgggcacaagatttaacactaccatggcaatcaggatcaggaggaatatggagggaaatgcatcatttagtagaatttgaaccaccacatgcagcaactataagagtattagcattgggaaatcaagaaggatcgcttaaaacagcgttgacaggagcaatgagagtaacaaaagatgaaaatgacaacaatttatataagctgcacggaggtcatgttagttgtagagtaaaattgagtgcactaacactcaaaggaacgtcctataaaatgtgcacagataaaatgagctttgttaaaaacccgacagatactggacatggaactgtagttatgcaagtaaaagtcccgaaaggggcaccatgcaaaatacctgtaatagtagcagacgatcttacagcagcagttaataaaggaatattagttacagtaaatccaatagcatcaactaatgatgacgaagtattaatagaagttaacccaccatttggagatagttatataatagtgggaactggagacagtaggttaacttaccaatggcacaaagaaggatcatcaatcggtaaattatttacacaaaccatgaaaggtgcagaacgtctagcagtaatgggagacgcagcttgggatttttcatcagctggtggattctttacatcagtaggaaagggtatacatacagtgtttggaagtgcattccaaggcttgttcggaggcttaagttggataacaaaagttataatgggagcagtcttgatatgggtaggaataaatactagaaatatgacaatgagtatgtctatgatattagtaggagtaataatgatgtttttaagtctaggagtaggagcagaccaaggatgtgcagtgaattttggaaag

SEQ ID NO: 908 - RNA, 2091 nt, synthetic construct
  misc_feature 1..2091: note = derived and/or modified CDS sequence (opt6) from YFV__AY968065__X-SS-prME-XX
  source 1..2091: mol_type = other RNA
atgagaggattatccagcagaaaaagaagatcgtcagaaatgactatgatgccactactaatattaagtatggtaattttaggtggaggagtaacactcgtcagaaagaacagatggcttctacttaatgtaacagcagaagatctaggaaaaacttttagcgtaggaactggaaattgcactactaatattctagaagcaaaatattggtgtcctgatagtatggaatataattgtcctaacttatcaccgcgtgaagaaccagacgatatagactgttggtgttatggagtcgaaaacgtcagagtagcttatggacgatgtgatgccgtgggaagaagcaaaagatcaagacgagcaattgatctaccaacgcatgagaatcatggattaaaaacacgacaagaaaaatggatgacaggtaggatgggagaaaggcaattacagaaaatagaaagatggttagtaagaaatccatttttcgcagtaacagcattagctatagcatatttagttggaaataacaaaacacaaagagtagtaatagcattattagtattagccgtaggtccagcatattcagctcactgtattggaataacagatcgagactttatagaaggcgtccatggcggtacatgggtatcagctagcttagaacaagataagtgtgtaactgtaatggcaccagacaaacctagtttggatatatcattacagacagtagctatagatggaccagcagaagctagaaaagtgtgttactcggcggtactaacacatgtgaaaataaatgataaatgtccttcaacaggagaagcacacctagcagaagaaaacgatggagataacgcatgtaaaagaacatacagtgatagaggttgggggaacggatgtggactattcggtaaaggtagcatagtagcatgtgctaagttcacatgtgcaaaaagtatgagcttattcgaagtagaccaaacgaaaatacagtacgtaataagagcgcaattacacgtaggagcgaaacaggaaaattggaatactgacataaaaacactaaaatttgacgcactaagtggatcacaagaagcagaatttacaggttatggaaaagcaacactagaatgtcaggtccaaaccgcagtcgatttcggaaatagctatattgctgagatggaaaaagacagttggatagtagacagacaatgggcccaagacctaactctaccatggcaatcaggaagcggaggaatatggagagaaatgcatcatttagtagaatttgaaccaccgcacgcagcaacaataagagtattagcattgggaaaccaagaaggttcattaaaaacagcgttaactggagcaatgagagtaacgaaagacgaaaatgataacaatctttacaaattacacggaggacatgtaagttgtagagtaaaattatcggcacttacattaaaaggaacgagttataaaatgtgtacagacaagatgagctttgttaaaaatcctacagatacaggacatggaacagtagtgatgcaagtaaaagtacctaaaggcgcaccatgtaaaatacccgtaatagtagcagatgatctaacagccgcagttaataaaggaatcctagtaacagtaaacccgatagccagcaccaatgacgatgaagtgcttatagaagtgaatccaccatttggagacagttatataatagttggaacaggagactcaagactcacatatcagtggcataaggagggaagcagtataggtaaattattcacacaaacaatgaaaggggtagaaagattagcagttatgggagatgcagcatgggatttttcaagcgcaggaggattctttacatcagtaggaaaaggaatacatacagtattcggatcagcattccaaggattatttggtggtttatcatggataacaaaagtaataatgggagcagtattaatatgggtaggaataaatacacgaaacatgactatgagcatgagcatgatacttgtcggagtaattatgatgttcttaagcctaggagtgggtgctgatcagggatgtgcggtaaattttggtaaa

SEQ ID NO: 909 - RNA, 2061 nt, synthetic construct
  misc_feature 1..2061: note = derived and/or modified CDS sequence (opt11) from YFV__L06480__X-SS-prME-XX
  source 1..2061: mol_type = other RNA
atgcgcggactaagctccaggaaacggcgctcgcacgatgtcctcaccgtacaattcctaatactaggaatgctgctgatgaccggtggggtaacgctagtacgcaaaaacagatggctcctactaaacgtcacaagcgaagacctgggcaaaacctttagtgtgggcacgggcaactgcacgacaaacatactagaagcgaaatactggtgccctgactccatggaatacaactgcccaaacctaagcccccgagaagaaccagacgacatagactgctggtgctacggagtcgaaaacgtgcgagttgcctacggcaagtgcgactccgcgggtaggagccgacgctcgcgcagagcaatagacctgccaacacacgaaaaccacggcctaaagacccgacaggaaaaatggatgaccggaagaatgggagagcgacagctacagaaaatagaacgatggttcgtcagaaaccccttctttgccgtaacagccctaacaatcgcgtaccttgtaggatccaacatgacacaacgagtagtaatagcgctgctagtactagcagtgggcccagcatacagcgcccactgcatcgggatcacggacagggacttcatcgaaggcgtgcacgggggcacatgggtgagtgccaccttggaacaagacaagtgtgtgacagtaatggctccagacaaaccctcactggacatcagcctggaaaccgtagcgatagaccgaccggccgaagccaggaaagtgtgctacaacgcagtactaacacacgtaaaaatcaacgacaaatgcccgagcaccggcgaggcccacctcgcggaagaaaacgaaggcgacaacgcatgcaaacgcacatactccgaccgaggctggggcaacggctgcggcctctttgggaaagggagcatcgtcgcgtgcgcaaagttcacatgcgcaaaaagcatgagcctattcgaggtagaccaaacgaaaatacaatacgtaatacgagcgcaactgcacgtaggagcaaaacaggaaaactggaatacctccatcaagaccctcaaattcgacgctctatcgggatcgcaagaggtagagttcataggctacggcaaagcaacgctcgaatgccaggtccaaaccgcagtcgacttcggcaactcgtacatagcagagatggagaccgaaagctggatcgtagacaggcagtgggcacaagatctaaccctcccctggcaatcgggttcaggcggagtatggcgagaaatgcaccacttagtagagttcgagcccccgcacgctgcgacaatccgagtcctggccctgggcaaccaagagggctcactcaaaacagcactcacaggagccatgcgagtcactaaagataccaacgacaacaacctctataaactccacggaggacacgtaagctgccgcgtgaagctaagcgcactcacactcaagggcacgagctacaaaatatgcacggacaaaatgttcttcgtgaaaaatccaacagatacaggacacggcacggtagtgatgcaagtcaaagtgccgaaaggagccccctgcaggatcccggtaatagtagcagacgacctaaccgccgccatcaacaagggaatactggtaacagtcaacccaatagcatcaaccaatgacgacgaagtactaatagaggtaaatcccccattcggagacagctacataatagtaggacgcggagactcgaggctaacctaccaatggcacaaagaaggaagcagtataggaaaactgttcacccaaacgatgaaaggagtagagaggctcgcagtcatgggtgacgtcgcatgggatttctcaagcgcagggggattcttcacaagcgtcgggaaaggaatccacacagtatttggaagcgcgtttcaaggtctcttcggaggcctcaactggatcactaaagtcataatgggagcggtactcatatgggtagggataaacaccaggaacatgaccatgagcatgagcatgattctagtcggagtaataatgatgttcctaagtctgggcgtgggcgcg

SEQ ID NO: 910 - RNA, 2091 nt, synthetic construct
  misc_feature 1..2091: note = derived and/or modified CDS sequence (opt11) from YFV__D14458__X-SS-prME-XX
  source 1..2091: mol_type = other RNA
atgcgaggactgtcatccagaaaacgccgatcatacgaggtcctgaccgtgcaattcctaatactcggaatgctactcatgacaggaggcgtgaccctggtaaggaaatcacgctggctactgctcaacgtcacaagcgaggacttgggcaaaacattcagcgtgggaacaggaaactgcacgacaaacatactagaagcgaaaaattggtgtccggactccatggaatacaactgcccaaacctctcaccgagggaagaaccagacgacatagactgctggtgctacggggtagagaacgtgagagtggcatacggaaagtgtgacagcgcaggccgatcacggcgatcgcgaagggcgatagacttgcccacgcacgaaaaccacggcctaaaaacgagacaggaaaaatggatgacagggcgcatgggagagagacagctccaaaagatagaaaggtggctggtaagaaacccgttcttcgcggtaaccgcgctagcaatcgcatacctagtaggaagcaacatgacgcaaagggtcgtaatcgcactcctggtcctggccgtaggaccagcctacagcgcacactgcatagggataactgaccgagacttcatcgagggcgtacacgggggcacatgggtgagcgcgacactggaacaggacaaatgcgtgacagtaatggccccagacaagccgagcctagacatcagcttggaaacagtagcgatagacggaccagcagaggcccgcaaagtgtgctacagcgcggtactcacccacgtcaagatcaacgacaagtgcccgagcacaggcgaggcgcacctggcggaagagaacgagggcgaccatgcgtgtaaacgaacctactctgatagggggtggggcaacggatgcggcctattcggaaaagggagcatagtcgcgtgcgcgaagttcacatgcgcaaagagcatgagtttgttcgaggtcgatcaaaccaaaattcaatatgtaataagggcgcaattgcacgtgggcgcgaaacaagaaaattggaacgcagatatcaaaacattgaaattcgacgcactatcaggatcgcaagaggccgagttcacaggctatgggaaagccacactggaatgccaggtccagacagccgtagacttctcgaactcgtacatagccgagatggagaaagagagctggatcgtagaccgccaatgggcccaagacctgacccttccatggcaatcgggatcagggggagtctggcgggagatgcaccacctggtagagttcgaaccaccccacgcagccacaatcaaggtcctcgccctgggcaaccaagaaggctcactcaagacggcactaacaggcgcgatgcgcgttacgaaggacacaaacggctcaaacctctacaagctccacggcggccacgtgagctgccgggtaaagctcagcgcgttaacactaaagggaacgagctacaaaatgtgcaccgataaaatgtccttcgtcaaaaaccccaccgacacggggcacggcacagcagtaatgcaggtaaaagtacccaaaggagccccgtgcaggatcccggtcatggtcgcagacgacctcaccgcctcggtcaacaaaggaatcttggtcacagtaaaccccatagcctcaaccaacgaagacgaagtcctcatagaagtgaacccgccattcggcgatagctatatcatagtcgggacaggagactcgagactaacctatcagtggcacaaagaagggagctcaatcggaaaactgttcacacaaacgatgaagggcgccgagagactcgcagtaatgggcgatgcagcgtgggacttcagcagcgcgggcggattcttcacatcggtgggaaaaggaatacacatggtgttcgggagcgcgttccagggactcttcggcggcctaagctggataacaaaagtcatcatgggcgccgtcttaatctgggtgggaatcaatatgagaaacatgacaatgtccatgagcatgatcctcgtcggagtaataatgatgttcctgagcctcggggtgggggcggaccagggatgcgccatcaacttcggaaaa

SEQ ID NO: 911 - RNA, 2091 nt, synthetic construct
  misc_feature 1..2091: note = derived and/or modified CDS sequence (opt11) from YFV__U21055__X-SS-prME-XX
  source 1..2091: mol_type = other RNA
atgagaggactcagctccaggaaacggcgctcacacgacgtcctgacggtacaattcctcatcctcggaatgctacttatgaccggcggagtaacactcgtacgcaaaaaccgatggctcttgctcaacgtcacaagcgaggacctaggaaagactttcagcatgggcacgggcaactgcaccaccaacatactggaggcgaagtactggtgcccagactccatggaatacaactgtccaaacctatcaccacgagaagaacccgacgacatagactgctggtgctacggagtagaaaacgtccgagtggcttatggaaaatgcgatagcgcaggccgaagccggagatcccgccgagccatagacctgccaacacacgagaaccacggcctaaaaacgcgccaagaaaagtggatgaccggccgcatgggtgaacgccaactacagaaaatagaaagatggttcgtccgaaacccgttcttcgccgtaacagcgctcaccatcgcatacttagtaggcagtaacatgacacaaagagtcgtaatcgcactcctggtactagccgtcggaccggcctacagcgcacactgcatcggaataacagaccgcgacttcatcgaaggcgtccacgggggaacatgggtgagcgccaccctcgaacaagacaaatgtgtgacagttatggcgcccgacaaaccctctctagacatcagtctggaaacagtagccatcgacggcccggtagaggccaggaaagtttgctacaacgccgtcctcacccacgtcaaaataaacgacaaatgcccctccacgggcgaagcccacctagccgaagagaacgaaggagacaacgcatgcaaaagaacctacagcgacagaggctggggcaacggctgcggcctgttcggcaagggctcaatcgtcgcgtgcgcaaaatttacctgcgccaaaagcatgagcctcttcgaagtagaccaaacgaaaatacaatacgtaatacgcgctcgactacacgtcggcgcaaaacaagagaactggaagaccgatataaagacgctgaaattcgacgccctgtcaggctcgcaagaggccgagttcacgggatacgggaaagcaacgctcgaatgccaggtacaaaccgcggtagacttcggcaacagctacatagccgaaatggaaaaagaaagctggatcgtcgacagacaatgggcacaagacctaaccttaccctggcaaagcggcagcggcggagtatggcgcgaaatgcaccacctagtagagttcgaacccccgcacgcagccacgataagagtactcgccctcggcgaccaggaaggatcactcaaaaccgcactgaccggcgcaatgcgggtcacaaaagacacgaacgacaacaacctctacaaacttcacggtggccacgtctcatgccgggtaaaactgagcgcgctcacgctaaaagggacatcctacaaaatgtgcaccgacaaaatgtcattcgtcaaaaaccccaccgacaccggccacggcacagtagtaatgcaagtcaaagtcccaaaaggcgccccatgcagaatcccagtaatagtcgccgacgacctaacggccgccatcaacaaaggaatcctcgttaccgtcaaccccatagcctccaccaacgacgacgaagtactaattgaagtgaaccctccattcggcgacagctatatcatagtcggaaccggcgactcacgcttgacctatcaatggcacaaagaagggagctcgatcggaaaactatttacccaaacgatgaaaggcgcagaaagactcgcagtaatgggcgacgccgcatgggacttctcaagcgcaggcgggttcttcacctcagtcggaaaaggaatccacaccgtattcggctccgccttccaaggactatttggcggcctgaattggatcacaaaggtaatcataggagcagtactgatatgggtggggatcaacacaagaaacatgaccatgtccatgagcatgatcctcgtcggggtcataatgatgttcctctccctcggagtgggcgcagatcaaggctgcgccatcaacttcgccaaa

SEQ ID NO: 912 - RNA, 2091 nt, synthetic construct
  misc_feature 1..2091: note = derived and/or modified CDS sequence (opt11) from YFV__U21056__X-SS-prME-XX
  source 1..2091: mol_type = other RNA
atgagaggactaagctcacgcaaaagacgcagccacgacgtcctaacagtccaattcctaatcctcggtatgctcctcatgacgggaggagtaactcttgtgcgcaagaataggtggctcctcctaaacgtgacctccgaagatcttggaaaaaccttcagcgtcggaacaggaaactgcaccaccaacatacttgaagcaaagtactggtgcccagacagcatggagtacaattgcccaaacctcagccccagggaagaaccagacgacatagactgctggtgctatggcgtcgaaaacgtgcgcgtcgcatacggcaaatgcgactcagccggacggtcccgccgaagccgccgagccatcgacctaccaacacacgaaaaccacggcctgaaaacgagacaagagaagtggatgaccggacggatgggagaaagacaactgcagaaaatagaacggtggctagtacggaaccccttcttcgcagtaacggcactgaccatagcctacctggtaggaagcaatatgacacaaagagtggtaatagccctgttagtcctagccgtaggccccgcgtactcagcccattgcatcggcataacagaccgcgacttcatagaaggagtccacggcggaacctgggtctccgcgacactagagcaagacaagtgcgtcaccgttatggcaccagacaaaccatccctagacatatcactcgaaacagtcgcaatagacgggcccgcagaggcgcgaaaagtctgctacaacgccgtcctcactcacgtgaagataaacgacaagtgcccctcgaccggagaagcgcacctggccgaagaaaacgaaggagacaacgcctgcaaaagaacctactccgaccgtggatggggcaacggatgcgggctattcggaaaagggtccatagtcgcctgcgcaaagttcacatgcgccaaatccatgagcctattcgaagtcgaccaaacaaaaatccaatacgtcatacgggcccagctacacgtgggcgcaaaacaagagaactggaacaccgacatcaaaacactcaaattcgacgctctgtccggcagccaagaagccgagttcaccggctacggaaaagcgacattagaatgccaagtgcaaacggccgtggacttcggcaacagctacatcgcagaaatggaaaaagaatcctggatagtagaccggcaatgggcacaagacctaaccctaccatggcaatccggaagcggcggcgtatggcgcgggatgcaccacctagtagagttcgaacccccacacgctgcaacaatccgggtcctcgccctaggcaaccaagaaggaagcctaaaaacggccctcacaggcgccatgcgagtgacaaaagacacaaacgacaataacctctacaaactccacggaggccatgtcagctgcagagtcaaactctccgccctcacactaaaagggacatcctataaaatgtgcacagacaaaatgagcttcgtcaaaaacccaacagacaccgggcacgggaccgtagtaatgcaggtcaaagtacccaagggcgccccgtgccgcatacccgtcatcgtggcagacgacctaaccgcagccatcaacaaagggatactcgtcactgtaaacccgatcgcctcaacaaacgacgacgaagtcctcatcgaagtaaatccacccttcggcgacagctacatcatagtaggcacaggggactcacgactgacgtaccaatggcacaaggaaggttccagcatcggcaagctattcacacaaacgatgaaaggagtagaaagactggccgtcatgggagacgcagcctgggacttttcaagcgccggaggatttttcacatcagtaggcaaaggcatacacacggtttttggatccgcattccagggactattcggcggcctaaactggatcaccaaagtcatcatgggggcagtgctaatatgggtcggcatcaacacccgcaacatgacaatgagcatgagcatgatcctagtaggcgtaataatgatgttcctaagcctgggagtaggcgccgaccaggggtgcgccataaacttcggcaag

SEQ ID NO: 913 - RNA, 2091 nt, synthetic construct
  misc_feature 1..2091: note = derived and/or modified CDS sequence (opt11) from YFV__U54798__X-SS-prME-XX
  source 1..2091: mol_type = other RNA
atgcgaggactcagtagcagaaaaaggcgctcccacgacgtcctaacagtacaattcctgatactaggaatgctactcatggccgggggagtaaccctagtcaggaaaaaccgatggctcctgctcaacgtaacaagtgaagacctaggaaaaaccttcagcgttggcacgggcaactgcacgacaaacatcttggaggcaaaatactggtgcccggactccatggaatacaactgcccaaatctctcacccagagaagaaccagatgacatagactgctggtgctacggagtagaaaacgtcagagtcgcatacggcaaatgcgatagcgcgggccggtcccggcgatcacgcagagcaatcgacctccccacacacgaaaaccacggactaaaaacgagacaggaaaagtggatgaccggacgaatgggagaacgccaactacagaaaattgaaaggtggctggtacgaaacccattcttcgccgtaacagcgctcgcaatcgcgtacctagtcgggtcaaacatgacgcaaagagtcgtgatcgcgttactggtcctagccgtaggacccgcctactccgcccactgcatagggataacggacagagacttcatcgagggcgtacacggaggcacgtgggtcagcgcgacactagaacaagataaatgcgtaaccgtaatggctccagacaaaccgagcctcgacatctcactggaaacagtcgcaatcgacggaccagcagaggcgcgaaaagtctgctacaacgcggtactaacgcacgtaaagataaacgacaagtgcccatccaccggcgaagcccatctagcagaagaaaacgagggcgacaacgcgtgcaaacgaacctacagcgacagaggatggggcaacgggtgcggcctgttcggaaaaggatcaatagtggcgtgcgctaagtttacctgcgccaaaagcatgtccctcttcgaggtggaccaaacgaaaatacaatacgtaattagagcgcaactccacgtgggagccaaacaagaaaactggaatacagacataaaaacactgaagttcgacgcactctccggatcacaagaggcagagttcaccggctacgggaaagccacactcgagtgccgggtccaaacggccgtcgacttcggaaactcctacatagccgaaatggagaaagaatcctggatagtagacaggcaatgggcccaggacttaacactaccatggcaatcaggatccggaggggtctggcgagagatgcaccacctggtcgagttcgaaccaccacacgcagccaccataagagtcctagccctaggaaaccaagaaggctccctcaaaacagcgctcacaggagccatgagagtcaccaaggacaccaacgacaacaacctgtacaaactccatggagggcacgtaagctgccgcgttaaactaagtgcactaacgcttaaaggcacgagctacaaaatgtgcacagacaaaatgtcattcgtgaaaaatccaacagacacagaccacggaacggtagtaatgcaggtcaaagtcccaaaaggagcaccctgcaagatccccgtcatagttgcagacgacctcaccgccgcaatcaacaagggaatcctagtgacggtaaaccccatagcatcaaccaacgacgatgaagtgctcatagaagtgaacccaccattcggagacagttacataatcgtcggaaccggagacagcagactaacatatcaatggcacaaagaaggcagctcaataggaaaactattcacccaaacaatgaagggcgccgaacgcctcgcagtaatgggcgacgcagcgtgggacttctccagcgcaggaggactcttcacctcaatcggaaaaggaagccacacagtcttcggaagcgcattccagggactattcggaggcctgagctggatcacaaaagtaatcatgggcgcagtcctaatatgggtcggaatcaacaccagaaacatgacaatgagcatgagcatgatactggtcggagtaatcatgatgttcctcagcctcggcgtcggggccgaccaaggttgcgcaataaactttggcaaa

SEQ ID NO: 914 - RNA, 2061 nt, synthetic construct
  misc_feature 1..2061: note = derived and/or modified CDS sequence (opt11) from YFV__AF052440__X-SS-prME-XX
  source 1..2061: mol_type = other RNA
atgagagggctatcaagcaggaaacgacgatcacacgatgtactgacagtgcaattcctaatactaggcatgctactcatgaccggaggcgtaaccctagtcagaaagaaccggtggctactgctcaacgttaccagtgaagacctaggaaaaacctttagcgttggcacgggaaactgcacaaccaacatcctggaagcaaaatactggtgccccgacagcatggaatacaactgccccaacctatcaccaagagaagaacccgacgacatagactgctggtgctacggagtagaaaacgtaagagtggcatatggcaagtgcgacagcgccggcaggagcaggcgttcgcgaagggccatcgacctgcccacgcacgaaaaccacggcttgaaaacgcgccaggaaaaatggatgaccggccgcatgggcgagcgccagctacagaaaatagaacgatggtttgtcaggaacccattcttcgccgtgaccgcgctcacgatcgcctatctagtagggagcaacatgacacaaagagtcgtgatagcgctcctcgtcttggccgtaggccccgcatactcagcgcactgcatcggaatcacggacagggacttcatcgaaggcgtacacggcggcacgtgggtgagcgcaaccctcgaacaggacaaatgcgtaaccgtaatggcgcccgacaaaccgagcctcgacatttccctagaaacggtcgcgatcgaccgccccgcagaagtcaggaaggtgtgctataacgcggtactaactcacgtcaaaattaacgacaaatgccccagcacgggagaagcacacctcgccgaagagaacgaaggagacaacgcatgcaaacgaacgtacagtgacaggggctggggcaacggctgcggactattcgggaaaggcagcattgtcgcgtgcgcaaaattcacgtgcgccaagagtatgtccctattcgaagtagaccaaacgaaaatacaatacgtcatacgagcacaactacacgtaggcgcaaaacaagaaaactggaccacagatatcaaaaccctgaaatttgacgcactctcgggctcacaagaggtcgagttcataggctatggtaaagcaacactagagtgccaagtccaaaccgcggtagatttcggcaactcctacatagccgagatggagacagaaagctggatagtagaccgacaatgggcacaagacctaaccctaccctggcaatcaggatccgggggagtctggcgcgaaatgcaccacctggtcgagttcgaacccccgcacgcagccacaataagggtcctggccctcggaaaccaagaaggctcactcaaaaccgcactgacgggcgccatgagggtcaccaaagacaccaacgataataacctatataaactccacggcggacacgtgtcctgcagagtcaaactaagtgctctcacgctaaaaggaacaagctacaaaatatgtactgataaaatgttcttcgtgaaaaaccccacggacacgggccacggaacagtcgtaatgcaggtcaaagtcagcaaaggagcaccgtgccggatacccgtcatagtcgcggacgacctcacggcagcaataaacaaaggaatcctagtcaccgtcaaccccatagcatcaacaaacgacgacgaagtactaatagaagtaaatccgcccttcggtgatagctacataatagtaggacgcggggactcacgcctgacataccaatggcacaaagagggcagctcgatagggaaactcttcacccaaacaatgaagggcgtcgagagactagcggtaatgggagacacagcatgggacttctcaagcgccgggggcttcttcacgtcagtagggaagggaatacacacagtattcggcagcgcgttccaaggcctgttcggagggctaaactggataacaaaagtgataatgggcgccgtactgatctgggtggggataaacacaaggaacatgacaatgagcatgagcatgatactggtaggagtcataatgatgttcctgagcctaggcgtaggcgca

SEQ ID NO: 915 - RNA, 2091 nt, synthetic construct
  misc_feature 1..2091: note = derived and/or modified CDS sequence (opt11) from YFV__AF052445__X-SS-prME-XX
  source 1..2091: mol_type = other RNA
atgcgcggactctcaagcagaaagcgccgatcacacgacgtcctgacagtacaattcctgatactcgggatgctattaatgacaggaggcgtcaccctagttaggaaaaaccgatggcttctactaaacgtaacgagcgaagacctaggcaaaacattcagtgtgggcaccggaaactgcacaaccaatatcctggaagccaaatactggtgcccggacagcatggagtacaactgccccaacctgtccccaagggaagaacccgacgacatagattgctggtgctacggagtagaaaacgtaagagtagcctacggcaagtgtgacagcgcaggccgaagcaggcgctcccgcagagcaatagacttacccacacacgaaaatcacggcctaaagacacgccaagagaagtggatgacaggacgcatgggcgagagacaacttcagaaaatcgaacgctggttcgtacgaaacccattcttcgcggtaaccgccctgacaatagcatacctggtaggcagcaacatgacacaaagggtagtaatcgcactgctagtcctagcagtaggaccggcatatagcgcacactgcataggcataacagacagagacttcatcgaaggagtgcacggcggaacatgggtaagcgcaaccctagaacaagacaaatgcgtaaccgtcatggcgcccgacaagccgtccctagacataagcctagaaacagtagcgatagaccgcccagccgaggttcgaaaagtgtgctacaacgcggtcctaacacacgtcaaaatcaacgacaagtgcccatccaccggagaggcacaccttgcagaagaaaacgagggcgacaacgcctgcaaaaggacatacagcgacaggggctggggaaacggctgcggcctattcggaaaaggaagcatcgtcgcgtgcgcgaaattcacatgtgccaaaagcatgagcctgttcgaagtagaccaaacgaaaatccaatacgtaatacgggcccaactgcacgtgggagcaaagcaagaaaactggaacaccgacatcaaaacccttaaattcgacgcgctatcaggcagccaagaagtcgagttcatcggatacggaaaagccacactagagtgccaagtccaaacagccgttgacttcggcaacagttacatagccgagatggagaccgaaagctggattgtagacaggcagtgggcacaagacctaaccctcccgtggcaatccggatctggcggcgtctggcgtgaaatgcaccacctagttgagttcgaaccaccgcacgcggccacaatcagagtccttgccctcggaaaccaagaaggcagcctaaaaaccgcactcacgggggcaatgcgggtaacgaaagacacaaacgacaacaacctgtacaaactacacggcggccacgtgagctgccgggtaaaactctccgccctcacactgaagggaacgagctacaaaatatgcaccgacaagatgttcttcgtcaaaaacccaacagacacgggacacggaacggtcgtaatgcaggttaaagtctccaaaggggcgccgtgccgaataccagtcatagtcgcggacgacctaacggcagcaatcaacaaaggcatcctagtcacggtaaatccaatagcctcgaccaacgacgacgaagtgctcatagaagtgaacccaccatttggcgattcctacataatcgtcggacgcggagactcaagactgacataccaatggcacaaagaagggagctcgatcggaaagctattcacacaaacaatgaaaggcgtagaaaggctcgcggtcatgggagacaccgcctgggactttagcagcgcaggcggattctttaccagcgtcggcaaaggcatccacacagtgttcggcagcgcattccaaggactctttgggggactaaattggataaccaaagtcatcatgggagtggtcctgatctgggtcggaatcaacacacggaacatgacaatgagcatgagcatgatcatggttggcgtaataatgatgtttctatcactaggggttggcgcagaccaaggctgcgcaataaacttcggcaaa

SEQ ID NO: 916 - RNA, 2091 nt, synthetic construct
  misc_feature 1..2091: note = derived and/or modified CDS sequence (opt11) from YFV__AF094612__X-SS-prME-XX
  source 1..2091: mol_type = other RNA
atgagaggactcagcagtagaaaaagacgatcgcacgacgtactgaccgtccaattcctcatactcgggatgctattaatgacaggaggcgtgaccctgatgcgcaaaaacagatggctactacttaacgttacaagcgaagacctaggcaagacattcagcataggaacaggcaactgcacaaccaacatcctagaagcaaaatactggtgcccggactccatggaatacaattgcccaaacctatcacccagggaagaacccgacgacatcgactgctggtgctacggagtagaaaacgtaagagtcacatacggaaaatgcgacagcgcgggtaggagccggcgctcaagaagggccatagacctacccacgcacgaaaaccacggactcaagactcgacaagaaaaatggatgaccgggcgcatgggggaaagacagctccagaaaatcgaaaggtggttcgtccgaaaccccttcttcgcagtgaccgcactcacgatcgcgtacctggtaggcagtaatatgacacaacgggtcgtgatcgcactgctcgtcctagccgtcgggccggcctactccgcccactgcataggggtcgccgacagagacttcatagaaggagtacacgggggcacatgggtcagcgcaacactggaacaagacaagtgcgtgacagtaatggcgccagataaaccaagcctggacatcagcctagaaaccgtagcaatagacggcccagtcgaagccagaaaagtatgctacaacgcagtcctcacccacgtgaaaatcgacgacaaatgcccgagtacgggagaagctcacctcgcagaagaaaacgaaggagacaacgcgtgcaaaagaacatacagtgacagaggctggggaaatggatgcggcctgttcggaaaaggaagcatcgtagcctgcgcaaagttcacatgtgcaaaaagcatgagcctattcgaagtcgatcagacgaagattcaatacgtaataaaagcacaactgcacgtgggcgcgaaacaggaagactggaaaaccgacatcaaaacactaaaattcgacgtactatcgggaagccaagaagcagagttcacgggatacggaaaggtcacactcgaatgccaggtccaaaccgcagtcgactttggaaactcatacatagccgaaatggagaaagaaagctggatcgtggaccgacagtgggcccaggacctcacactgccctggcaatcggggagcggaggagtttggcgcgaaatgcaccacctggtagagttcgaaccgccccacgcggcaacaatcagagtcctggccctaggcgaccaagaaggctccctaaagaccgccctaaccggcgcaatgagagtgacgaaagacaccaacgacaacaacctatacaaactgcacggcggacacgtttcatgcagagtgaaactaagcgcgctcacgctaaagggaacgagctacaaaatgtgtaccgacaagatgagcttcgtcaaaaaccctacagacaccggccacggcacggtcgtaatgcaggtaaaagtcccaaaaggagccccatgcaaaatccccgtaatagtagcagacgatctgacggcggcaataaacaaagggatactggtaacagtaaacccaatagcctccacaaacgacgacgaagtactgatcgaagtaaatccgccattcggagacagctacataataatagggacaggggacagccgcctgacatatcaatggcacaaagaagggtcaagcatcggcaaactattcacgcaaacgatgaaaggcgcagaaaggctagcagtaatgggcgacgccgcctgggacttctccagcgccggcggattcttcacatcagtcggcaaaggaatacacaccgtgttcggaagcgcgttccaagggctattcgggggactaaactggatcacaaaggtaatcatgggcgcagtgctaatctgggtcggattcaatacccggaacatgacaatgagcatgagcatgatattagtcggcgtcataatgatgttcctaagcctaggagtgggcgccgaccagggctgcgcgataaacttcggcaaa

SEQ ID NO: 917 - RNA, 2091 nt, synthetic construct
  misc_feature 1..2091: note = derived and/or modified CDS sequence (opt11) from YFV__KF769015__X-SS-prME-XX
  source 1..2091: mol_type = other RNA
atgcgcgggctgagcagccgaaaacgacgcagccacgatgtactaaccgtgcaattcctaatcctaggaatgctactcatgacgggaggggtaacactcgtgcgcaaaaacagatggctcctactaaacgtaacaagcgaggacctaggcaaaaccttcagcgtaggaacaggcaactgcacgaccaacatcctcgaagcgaagtactggtgccctgacagcatggagtacaactgtccaaacctaagccccagagaggaacccgacgacatagactgctggtgctacggagtagaaaacgtacgcgtcgcctacggaaaatgcgactccgcaggccgctcccgccgctctagaagggccatagacctaccaacacacgagaaccacggtctaaagaccagacaagaaaaatggatgaccggacgcatgggcgaaagacaactgcagaaaatcgaaaggtggttcgtgaggaaccctttcttcgccgtaaccgcgctaacgatcgcatacctagtcgggagtaacatgacccaacgagtcgtaatcgcgctcttggtcctcgcagtaggaccggcgtacagcgcacactgcataggaatcaccgacagagacttcatagaaggagtgcatggcggaacatgggtaagcgccacactcgaacaagacaaatgcgtaacagtcatggcgcccgacaaacctagtctagacatatcactggaaacagtagcaatcgacagacctgccgaagtaaggaaagtctgctacaacgcagtactaacacacgtaaaaatcaacgacaaatgccccagcacaggggaggcacacctcgcagaagaaaacgaaggcgacaacgcatgcaaacgaacttacagcgaccgcggctggggcaacggatgcggcctatttggtaaaggcagcatcgtcgcatgcgccaaatttacctgcgcaaagagcatgagcctgttcgaagtcgaccaaaccaaaatacaatacgtaatccgggcacaactccacgtaggagcaaaacaagaaaactggacaaccgacatcaaaaccctgaagtttgacgcactatccggctcgcaggaagtcgagttcatcggctacggcaaagccaccctcgaatgccaggtgcagactgcagtagatttcggcaactcgtacatagccgagatggaaactgaaagctggatcgtagaccgccaatgggcacaagacctaaccctcccttggcaatccggttcaggcggggtttggcgggaaatgcaccacctcgtcgagttcgagcccccacacgcggctacaatacgtgtgctcgcgctcgggaaccaagaaggatcgctcaagaccgcactaaccggcgcaatgcgagtaacaaaagacacaaacgacaacaacctatacaaactacacggcggccacgtaagctgccgagtaaagctcagcgccttaacactcaaaggaacctcctacaagatctgcaccgacaaaatgttcttcgtcaaaaacccgacggacacaggccacggaacagtagtaatgcaggtcaaagtcagcaaaggggccccgtgccgcataccagtcatagtagccgacgacctaacagcagcaataaacaagggcatcctagtaacggtcaaccccatagccagcaccaacgacgacgaagtcctaatagaagtgaacccaccattcggcgactcatacataatagtcggacgaggagacagcagactgacctaccaatggcacaaggagggaagctcaataggaaagctattcacccaaacaatgaagggtgtcgagagactcgcagtgatgggagacaccgcctgggacttctccagcgcaggaggcttcttcaccagcgtaggcaaagggatacacacggtcttcggaagcgcattccaaggactcttcggaggcctaaactggatcacaaaagtaatcatgggagcagtcctgatctgggtcggaatcaacaccagaaacatgaccatgagcatgtccatgatcctagtaggggtcataatgatgttcctcagcctcggcgtaggcgcagaccaaggctgcgcaatcaatttcggaaaa

SEQ ID NO: 918 - RNA, 2091 nt, synthetic construct
  misc_feature 1..2091: note = derived and/or modified CDS sequence (opt11) from YFV__KF769016__X-SS-prME-XX
  source 1..2091: mol_type = other RNA
atgcgaggactatcgagccggaaacgccggagccacgatgtcctcaccgtgcaattcctcattttaggaatgctactcatgacaggcggcgtgacgctagtcaggaaaaacagatggctattactcaacgtgacgagcgaagacctgggcaaaaccttcagcgtcgggacaggaaattgcaccacaaacatcctcgaagccaaatactggtgccccgactcaatggaatacaactgcccaaacctcagcccaagagaggagccagacgacatcgactgctggtgctacggagtagaaaacgtcagagtagcgtacggcaaatgcgactccgcagggcgctcaagacgatcaagacgggcgatcgacctaccaacacacgaaaatcacggcctcaaaaccagacaagaaaaatggatgaccggacgcatgggagaaagacaactccagaaaatagagagatggctagtacgaaacccattcttcgccgtaacagccctaaccatagcctacctagtcgggagcaacatgacacaacgagtcgtaatcgccctgctagtgctagccgtaggaccggcctacagcgcacactgcataggcataacggaccgagacttcatcgaaggcgtccacggaggtacttgggtcagcgcaacattagaacaagacaaatgcgtcaccgtgatggcacccgacaaaccgagcctagacatctcacttgaaacagtcgccatagacggcccagccgaagcgcgaaaagtatgctacaacgccgtccttacccacgtaaagatcaacgacaaatgccccagcaccggcgaagcccacctagccgaagaaaacgaaggcgataacgcctgcaaacgcacctacagcgaccgcgggtggggaaacggatgcggactattcggcaaaggaagcatagtagcctgcgcaaagttcacatgcgctaaaagcatgagcctattcgaagtggatcaaaccaaaatacaatacgtaatacgggcccaactccacgtaggtgccaaacaagagaactggaacaccgacatcaaaaccctcaaattcgacgcactatctggcagccaagaagcagagttcacaggatacggcaaagccacactggaatgccaagtccaaacagcggtagacttcgggaacagctacatagcagaaatggaaaaggaatcctggatcgtcgaccgacaatgggcacaagacctaacattaccctggcaaagcggcagcggcggcgtctggcgagagatgcaccacctcgtcgagttcgaaccaccgcacgcagccaccatacgggtcctcgccttaggcaatcaggaaggcagcctcaaaaccgcgctcacaggcgcaatgagagtaaccaaagacaccaacgacaacaacctctacaaactccacggaggccacgtcagctgcagagtaaaactaagcgcgctaacccttaaaggcacgagctacaaaatgtgcacagacaaaatgtccttcgtcaagaacccaacggacaccggacacggaaccgtagtaatgcaggtcaaagtgcccaaaggagcaccatgcaagataccagtcatagtggcagacgacctcaccgcagcgatcaataaaggaatcttagtaacagtcaaccccatagcatcaacgaacgacgacgaggttctaatcgaagtaaacccacccttcggagacagctacataatagtaggaaccggagacagccgattaacctaccaatggcacaaagagggaagtagcataggcaagctctttacacaaacgatgaaaggagccgagcggctagcagtaatgggagacgccgcctgggacttctcctcagccggcggcttcttcacaagcgtcggcaagggcatacacaccgttttcggaagtgcatttcagggcctcttcggaggactaaactggataacgaaagtaatcatgggcgcagtactgatctgggtcggaataaacacaagaaacatgacaatgtcgatgtcgatgatcctagtaggggtcataatgatgttcctctccctgggcgtcggcgccgaccaagggtgcgcaattaacttcggcaag

SEQ ID NO: 919 - RNA, 2091 nt, synthetic construct
  misc_feature 1..2091: note = derived and/or modified CDS sequence (opt11) from YFV__KF907504__X-SS-prME-XX
  source 1..2091: mol_type = other RNA
atgcgcggactgtccagcagaaaaagacgatcacacgaagtactaacggtacaattcctaatactaggcatgctactaatgaccggaggggtcacgctggtccgaaaatcgcgatggctgctcctcaacgtcacgagcgaggacctagggaagactttcagcgtaggcacaggcaactgcacgaccaacatcctagaagccaaaaactggtgcccagacagcatggaatataactgccccaacctctcaccccgggaagaacccgacgacatagactgctggtgctacggagtagaaaacgttcgcgtagcatatggcaaatgcgactccgcaggacgaagccgacgcagccgcagggccatagacctacccacccacgaaaaccacggactaaaaacccgacaagaaaaatggatgaccggtaggatgggtgagcgacagctccagaagatcgaaagatggctcgtccgcaatccattcttcgcagtaaccgcgctcgcgatcgcatacctagtcgggagcaacatgacccagagagtggtgatcgccctcctcgtcctagccgtaggaccagcttacagcgcacactgcatcggaataactgacagggacttcatagaaggggtgcacggaggaacatgggtatccgcaacactcgaacaagacaaatgcgtaacagtcatggccccggacaaaccgagcctagacatcagcctcgaaacagtggccatcgacggaccggccgaagcccgaaaagtgtgctacagcgcggtactcacccacgtaaagataaacgacaaatgcccaagcacgggcgaagcccacctcgcagaagaaaacgaaggagaccatgcctgcaagcgcacttacagcgacagaggctggggcaacggatgcggcctattcggcaaagggagcatagtagcgtgcgcaaaattcacgtgcgcgaaaagcatgtcactcttcgaagtagaccaaacaaagatacagtacgtaatccgagcccagctacacgtaggcgccaaacaagaaaactggaacgccgacatcaaaacactcaaattcgacgcactatcaggcagccaagaagcggagttcacgggatacggcaaggcaaccctcgaatgccaagtacaaaccgcggtagacttctcaaacagctacatagccgaaatggaaaaagaaagctggatagtggacagacaatgggcgcaagacctcacactaccatggcagtcaggaagtgggggagtctggagagaaatgcatcacttagtcgagttcgaacctccccacgcagctacaataaaagtactagcactaggaaaccaagaaggatcactgaaaacagcactaacgggagcaatgagggtcacaaaagacacaaacggcagcaacctatacaagctacacgggggacacgtgagctgccgcgtcaaactgtcagcactgaccctcaaaggcacaagctacaaaatgtgcacagacaagatgagcttcgtcaaaaaccccacagacacaggacacggcacggccgtaatgcaagtaaaagtcccaaaaggggccccctgcaggataccagtaatggtcgcagacgacctaactgcaagcgtcaacaaaggaatcctcgtaaccgtcaacccaatagcctccacaaacgaagacgaagtactaatagaagtaaacccaccgttcggggacagctacatcatagtcgggacaggagactcacgcctaacataccaatggcacaaagaaggatcaagcatcggaaagctattcacacaaacaatgaaaggcgcggaacgactagcagtcatgggagacgccgcatgggacttcagcagcgcaggaggcttcttcaccagcgtcggcaaaggcatacatatggtattcggctccgcattccaaggactattcgggggcctgtcctggataacgaaagtaattatgggcgcagtcctaatctgggtaggaataaacatgagaaacatgaccatgagcatgagcatgatcctagtcggcgtgattatgatgttcctgagcctaggcgtaggagccgaccaaggatgcgcaatcaacttcggccga

SEQ ID NO: 920 - RNA, 2091 nt, synthetic construct
  misc_feature 1..2091: note = derived and/or modified CDS sequence (opt11) from YFV__JF912179__X-SS-prME-XX
  source 1..2091: mol_type = other RNA
atgcgcggactcagctcacgaaaaagacgcagccaagacgcccttacagtccaattcctcatactcggcatgctgctcatggtcgggggcgtaacactcgtccggcgaaatagatggctactactaaacgtgacgagcgaagacctagggaaaaccttcagcgtaggcaccggcaactgcacaaccaacatactggaagcgaaatactggtgccccgacagcatggaatacaactgcccaaacctcagcccccgggaagaaccagacgacatagactgctggtgctacggcgtcgaaaacgtccgcgtcgcatacggcaaatgcgacagcgcaggaagatcacgccgttcgcgacgcgccatagacctgcccacccacgaaaaccacggactaaaaacacggcaagaaaaatggatgaccgggaggatgggcgaacgacaactacagaaaatcgaaaggtggctagtacgaaacccgttctttgcagccacagcgttagcgatcgcgtacctagtcggatcaaacatgacacaaagagtcgtaatcgcgctcctagtcctagcggtgggacccgcatacagcgcacactgcatcggcatcacagaccgggacttcatagaaggggtgcacggaggaacctgggtgagcgccacattggaacaagacaaatgcgtaacagtcatggcacccgacaagccctcactagacatcagcctcgaaactgtcgcgatagacggcccagccgaagccaggaaagtgtgctacagcgccgtcctaaccaacgtgaaaataaacgacaagtgtccatccaccggcgaagcccacctagaggaagaaaacgaaggagacaacgcatgcaagcgcacatactcagacagaggctggggcaacggatgcggcctattcggaaaaggatccatcgtagcgtgcgccaaattcacctgtgccaaaagcatgagtctattcgaagtagaccagaccaaaatccaatacgtcatcagagcacaactacacgtaggagcaaaacaagaaaactggaacacagacatcaagaccctaaaattcgacgccctcagcggcagccaagaggccgagttcactggatacggcaaagcaaccctagaatgccaagtacaaaccgcagtcgacttcagcaattcgtacatcgccgaaatggaaaaggaaagctggatagtggacaaacaatgggcccaggatctaacactaccatggcaatccggcagcggaggcgtatggagggagatgcaccacctcgtagagttcgaaccaccacacgcagcaacaataaaagtactcgcactgggcaaccaagaaggaagcctcaaaaccgcgctaacaggcgccatgagagtcacaaaagacaccaacaacagcaagctctacaagctacacggcggccacgtagcatgcagagtgaaattatcagctctcacgctaaaaggaacctcatataaaatgtgcacagacaaaatgagcttcgtaaagaacccgacagacacaggacacggaacagcggtaatgcaagtaaaagtaccaaaaggagcaccctgcagaatcccagtcatggtggcagacgaccttaccgccgcagtcaacaaagggatcctagtcacggtcaaccccatagcatccaccaacgacgacgaggtcctcatcgaagtcaacccgcccttcggcgacagctatataatagtcggcaccggagactcccgactcacctatcaatggcacaaagaaggatcctcaatcggcaaactattcacgcaaactatgaaaggagcggaaagactcgccgtcatgggagatgcagcctgggacttcggcagcgcaggaggcttcttcacatcagtcgggaagggcatccacacggtattcggatccgcattccaggggctattcggcggtctcagctggatcacaaaagtcataatgggagtcgtcctcatctgggtggggatcaacacccggaatatgacaatgagtatgtcaatgatcctagtcggggtcataatgatgttccttagcttaggagtcggagccgaccaaggatgcgcgataaacttcagcaaa

SEQ ID NO: 921 - RNA, 2091 nt, synthetic construct
  misc_feature 1..2091: note = derived and/or modified CDS sequence (opt11) from YFV__JF912180__X-SS-prME-XX
  source 1..2091: mol_type = other RNA
atgagaggactatcgagcaggaaaaggagaagccaagacgtcctcaccgtccaatttctcatcctcgggatgctactcatggtagggggcgtaaccctagtcagaagaaatagatggttactcctcaacgtaacatccgaagacctagggaaaacattcagcgtaggaacaggcaactgcacaacgaacatcctagaggcaaagtactggtgccccgacagtatggagtacaactgccccaacctatcacccagggaagaacccgacgatatcgactgctggtgctacggagtcgaaaacgtgcgcgtcgcctacggcaaatgcgactcagcgggccgcagccggcgcagccgaagggccatcgacctaccaacacacgagaaccacggattaaaaacaagacaagaaaaatggatgacaggacgaatgggagaacgccaactccagaaaatagaaagatggctcgtgagaaacccattctttgcagcgaccgcactcgcaatcgcatacctcgtcgggtcaaacatgacccaaagagtagtaatagcgctcctagtactggccgtgggaccagcatacagcgcacactgtatcgggataacggacagagatttcatagaaggggtgcacggcggaacgtgggtatcagcgaccctagaacaagacaaatgcgtaaccgtgatggcacccgacaaacccagcctggacataagcctagaaacggtggctatcgacggaccagcagaagctaggaaggtgtgctacagcgcggtactcaccaacgtcaaaattaacgacaaatgcccgtcaacaggagaagcccacctcgaagaagagaacgaaggagacaacgcgtgcaagagaacatactccgacagaggatggggcaacggctgcggactgttcggaaaaggaagcatcgtcgcatgcgcgaaattcacatgcgccaagagcatgagcctcttcgaggtagaccagacgaaaatccaatacgtaatacgcgcacagctccacgtaggcgccaaacaagaaaattggaacaccgacatcaagaccctgaaattcgacgcgctatcgggatcgcaggaggccgagttcacgggctacggcaaagccaccctggagtgccaagtacaaactgccgtcgacttctcaaactcatacatcgccgaaatggagaaagagagctggatagtggataaacaatgggcacaagatctgaccctgccctggcaatccggctcgggaggggtctggcgcgagatgcaccacctcgtcgagttcgaacccccacacgcggccacgataaaagtcctggccctgggcaaccaggaaggcagcctgaaaacagcgctaacaggcgcaatgagggtaacaaaagacacaaacaactcaaaactgtacaagctccacggcgggcacgtaagctgccgcgtcaaacttagcgcgctcacgctcaaaggcaccagctacaaaatgtgcaccgacaagatgtcattcgtcaagaatcccacagacacaggacatggaaccgccgtaatgcaagtaaaggtaccaaaaggggccccctgcagaatcccggtcatggtggccgacgacctcaccgccgcagtaaacaaaggaatactggtaacagtaaaccctatagcctccaccaacgacgacgaagtactaatcgaagtaaacccaccattcggcgatagctacatcatagtcgggaccggggactcgcggctcacataccaatggcacaaggaaggaagttcgatcggaaaattattcacccaaacaatgaaaggcgcggaaagactcgcagtgatgggcgacgccgcgtgggacttcggaagcgcaggcggattcttcacatcagtcggaaaaggcatccacacagtgttcggaagcgcattccagggactcttcggaggcctaagctggatcaccaaggtaataatgggagtagtactcatctgggtggggatcaacaccaggaacatgacgatgagcatgagtatgatactggtcggagtaataatgatgttcctgagcctgggagtaggagcggaccagggatgcgcgataaacttcggcaaa

SEQ ID NO: 922 - RNA, 2091 nt, synthetic construct
  misc_feature 1..2091: note = derived and/or modified CDS sequence (opt11) from YFV__JF912181__X-SS-prME-XX
  source 1..2091: mol_type = other RNA
atgcgaggactatcgagcagaaaaaggcgcagccacgaagtattaaccgtccatttcctcatattagggatgatgctaatgaccggaggagtgacactggtccgcaaatcacgctggctcttgctgaacgtaacatccgaggacctaggtaagacattctccgtaggcacaggtaattgcacaaccaacatactagacgcgaagaattggtgtcccgacagcatggaatataactgccccaacctcagcccaagggaagaacctgacgacatagactgctggtgctacggcgtagaaaacgtgagagtagcctacggcaaatgcgacagtgcaggccgaagcaggcgctccagacgagccattgacctgcccacccacgagaaccacggcctaaaaacaagacaggaaaagtggatgacgggacgaatgggagaaagacagctacagaaaatagaaaggtggctggtgagaaacccgttcttcgcagtaacagcgctcgcaatcgcgtacctcgtcgggagtaatatgacacaaagagtcgtaatagcgctcctggtactagcagtgggcccagcctacagcgcgcactgtatcgggatcacggacagagacttcatcgaaggagtacacggaggaacgtgggtcagcgcaacattagaacaagacaagtgcgtgacagtaatggcacccgacaaacccagcctggacatctcactagaaacagtcgcgatcgacggaccggccgaggcaaggaaggtatgctactccgcggtcttgacccacgtcaagatcaacgataaatgcccgagcacaggcgaggcccacctcgcagaagaaaacgaaggcgacaacgcatgcaaacgaacgtactcagacaggggatggggcaacggatgcgggctgttcggaaaaggaagcatagttgcatgcgccaaattcacatgcgccaaaagcatgagcctgttcgaagtcgaccaaacgaaaatacagtacgtaatacgcgcacaactgcacgtaggagcaaaacaagaaaactggaacgccgacataaagaccctgaaattcgacgcactatcaggctcgcaagaggccgagttcaccggctacggcaaggcgacccttgaatgccaagtccagacagcggtggacttcagcaactcgtacatagccgaaatggagaaagaatcatggatcgtggacagacaatgggcacaagacctaacattaccctggcagtcgggatcagggggcgtatggcgagagatgcaccacctagtagagttcgaaccaccacacgcggccacaatcaaggtcctagccctcggaaaccaagaaggaagtctcaaaaccgccctcaccggcgcgatgagggtgacgaaagacgccaacggatcaaacctctacaaactacacggcggacacgtaagctgccgcgtgaaacttagcgcactaaccctcaaaggcacgagctacaaaatgtgcacagacaagatgagctttgtcaaaaacccaacagacaccggccacggcacggccgtaatgcaggtcaaggtaccgaaaggggcgccctgcagaataccagtcatggtcgcggacgacctaacagccgcagtaaataaagggatcctggtgacggtcaaccccatagcatccaccaacgaagacgaagtgcttatagaagtgaacccgccatttggcgacagctacataatagtcggaaccggggactcgagactaacctaccaatggcacaaagaaggaagctcaatcggaaaactcttcacacaaacaatgaaaggagcggaacgactcgcggtcatgggggacgcagcgtgggacttctcgagcgcaggcgggttcttcacctcggtcggaaaaggaatacacatggtatttggaagtgcattccagggcttgtttggaggactctcctggatcacaaaagtaatcataggagcagtactcatctgggtcggaatcaacatgaggaacatgaccatgagtatgggcatgatcctagtcggagtcataatgatgttcctcagcctgggcgttggcgcggaccagggctgcgcaataaacttcgggaag

SEQ ID NO: 923 - RNA, 2091 nt, synthetic construct
  misc_feature 1..2091: note = derived and/or modified CDS sequence (opt11) from YFV__JF912182__X-SS-prME-XX
  source 1..2091: mol_type = other RNA
atgaggggactaagcagcagaaaaagacgatcccaagacgtccttaccgtacaattcctcatactagggatgctactgatggtgggaggagtgacgctagtacggaaaaaccgatggctgctgctgaacgtcacgtcagaagaccttggcaaaacctttagcgtaggaacaggaaactgcaccaccaacatcctggaagcgaaatattggtgccccgactcaatggaatataactgccccaacctcagccccagggaggaacccgacgacatagactgctggtgctacggcgtcgaaaacgtacgagtagcatacggcaaatgcgacagcgcgggcagatcaaggcgctcacgacgagccatagacctccccacacacgaaaaccatggcctcaaaacacgacaagaaaaatggatgacaggacgcatgggagagagacaactccagaaaatagaacgatggttagtacggaacccgttctttgcagcgaccgcactagcgatcgcctacctagtaggtagcaacatgacacaaagggtcgtcatagcactcctggtactagccgtgggcccggcatacagcgcccactgcataggaataaccgacagagactttatcgagggtgtacacggcggtacgtgggtgagcgcaaccctagaacaagacaagtgcgtaacagtcatggcgccagacaaaccaagcctcgacatcagcctagaaacagtcgcaatagacggcccagccgaagcacggaaagtatgctacagtgcagtgctcacaaacgtcaaaatcaacgacaaatgccccagcacaggagaagcacatctcgaagaagagaacgaaggagacaacgcgtgcaaaagaacgtacagcgacagaggctggggcaacggctgcggcctattcggaaaaggaagtatagttgcatgcgcgaaattcgcctgtgccaaaagcatgtccctgttcgaggttgaccaaaccaaaatacaatacgtaatacgcgcgcaattgcacgtgggcgcgaagcaagagaattggaacaccgacatcaaaacactcaaattcgacgcgctctcaggctcacaagaagcagagttcacaggctacgggagagccaccctcgaatgccaggtacaaacagcggttgacttctcaaactcatacatcgccgaaatggaaaaagagagttggatagtagacaaacaatgggcacaggacctaaccctgccctggcaatcgggctcgggaggagtatggcgggaaatgcaccatctggtagagttcgaacccccgcacgcggcaaccatcaaagtcctagccctgggcaaccaagaaggatcgctcaaaaccgcgctaacgggcgcgatgagggtcaccaaagacacaaacaactcaaaactgtacaaactccatggcggccacgtagcctgccgcgtgaaactaagcgcactaaccctaaaaggaacaagttacaaaatgtgcaccgacaaaatgtcattcgtgaaaaacccaacagacaccggacacggcacagccgtcatgcaagtaaaagtaccaaaaggggccccctgtagaatcccagtcatggtcgccgacgacctcacagcagcggtcaacaaaggcatcctagttaccgtcaaccccatagcctcaacaaacgacgacgaagtactaatagaagtgaacccacccttcggcgacagctacataatagtcggaacaggagacagccgactgacataccaatggcacaaggagggcagcagcatcggaaaactgttcacacaaaccatgaagggcgccgaaagactcgccgtaatgggcgacgccgcatgggacttcgggagcgccggcggattcttcacgagcgtaggaaaagggatccacaccgtatttggaagcgcgttccaaggcctgttcggcggcctcagttggataaccaaagtaatcatgggagtcgtactgatatgggtaggcattaacacacgtaacatgacaatgagcatgagcatgattctagtaggggtaataatgatgttcctcagcctaggagtgggagcggaccaaggctgcgcaataaatttcggaaaa

SEQ ID NO: 924 - RNA, 2091 nt, synthetic construct
  misc_feature 1..2091: note = derived and/or modified CDS sequence (opt11) from YFV__JF912183__X-SS-prME-XX
  source 1..2091: mol_type = other RNA
atgcgaggactatcgagcagaaagcgaaggagccaagatgtactcacggtccagttcctaatactcggcatgctactaatggtcggaggcgtaacactggtaaggagaaaccgctggctactactcaacgtaacaagcgaggacctaggaaaaacattcagcgtgggaacaggcaactgcacaacgaacatactagaagcaaaatattggtgccccgatagcatggaatacaactgcccaaatcttagcccgagagaagaacccgacgacatcgactgctggtgctacggagtagaaaacgtacgcgtggcatacgggaagtgtgacagcgccggccgcagcagaagaagtcgacgagccatagatctgcccacgcacgagaaccacggactaaaaaccagacaagaaaaatggatgacaggacgaatgggcgaacgccaactacagaaaatagaacgctggctggtccgaaacccgttctttgcagcaacagccctcgcaatcgcttacctggtcgggtcaaacatgacacaaagagtagtaatagcattgttagtactagcagtaggcccggcctacagcgcacactgcatagggataacagaccgagacttcatcgagggcgtacacggaggaacgtgggtgagcgcaaccctcgagcaagataaatgcgtaaccgtaatggcgccggacaagccaagcctcgacataagcctcgaaaccgtagcaatagacggcccagccgaggcccggaaagtatgctactccgcagtcctaaccaacgtcaagataaacgacaaatgcccaagcaccggagaagcacacctcgaagaagaaaacgagggcgacaacgcgtgcaaacgcacgtacagcgataggggctggggcaacggctgcggcctattcggtaagggaagcatagtcgcatgcgcgaaattcacatgcgccaaaagcatgagcctcttcgaagtggatcaaaccaaaatacaatacgtaatacgagcacagctacacgtaggagcaaaacaggagaattggaacacagacataaagaccctcaaattcgacgcactctccggaagccaagaagccgagttcacaggatacggcaaggccacactggaatgccaagtccagaccgccgtcgacttcagcaacagctacatagcggaaatggaaaaagaaagctggatagtagacaaacagtgggcacaagacctaacactaccatggcaaagcggctcaggcggcgtatggcgcgaaatgcatcatctggtagagttcgaaccgccccacgccgcaactatcaaggtattagcccttggaaatcaagagggaagcctgaaaacagcactaacgggagccatgcgcgtaacgaaagacaccaacaacagcaaactatacaaactccacggcggacatgtggcatgccgcgtcaagctcagtgcactcacactcaagggcacgtcatacaaaatgtgcacagacaaaatgtccttcgtcaaaaaccccacagacaccggccacggcacagccgtaatgcaggtaaaggtaccaaaaggcgcaccttgccgcattccagtcatggtcgcggacgacctcaccgcagctgtaaacaaggggatcctagtaactgtgaacccaatcgcaagcacaaacgacgatgaagtcctcatcgaagtaaacccaccattcggcgacagctacatcatagtagggacaggagacagcagactcacctaccaatggcacaaggaaggcagcagcatcggaaagctattcacacaaacaatgaaaggcgcagaaaggctagctgtgatgggcgatgccgcctgggacttcgggagcgcgggagggttcttcacctcggtagggaaaggcatccatacagtgttcggcagcgcgttccaaggactattcggcgggttgagctggatcaccaaggtgatcatgggggtcgtcttaatctgggtagggataaataccagaaacatgaccatgagcatgagcatgattctagtcggagtaataatgatgttcctaagcctaggcgtgggcgccgaccaaggctgcgccataaacttcggaaag

SEQ ID NO: 925 - RNA, 2091 nt, synthetic construct
  misc_feature 1..2091: note = derived and/or modified CDS sequence (opt11) from YFV__JF912184__X-SS-prME-XX
  source 1..2091: mol_type = other RNA
atgagggggctatcaagtcgaaagaggcgcagtcaagacgccctcaccgtacaattcctcatcctgggaatgctcctcatggtcgggggcgtaaccctagtaagaagaaacagatggctactcctaaacgtaacaagcgaagacctgggcaaaacgttcagcgtcggcacaggaaactgcacaacgaacatcctagaagcaaagtactggtgccccgactcgatggaatacaactgccccaaccttagcccgcgagaagaacccgacgacatagactgctggtgctacggggtcgagaacgtaagagtagcctacggaaaatgcgacagcgccgggagaagcaggagaagccgcagagcgatagacctgcccacacacgaaaaccatggcctaaaaacaaggcaagaaaagtggatgaccggccgaatgggagaacgccaactccagaaaatagaacgatggctagttagaaacccgttctttgcagcaaccgcactcgcgatagcgtatctagtcggaagcaacatgacgcaacgagttgtgatcgcgctcctagtcctagcagtgggcccagcctacagcgcccattgcatcgggatcacagaccgagacttcatagagggagtgcacgggggaacatgggtaagcgcaacacttgagcaagacaaatgcgtgacagtaatggcaccagacaaaccgagcctggacataagcctcgaaacggtcgcaatagacggaccagcagaagccagaaaagtatgctacagcgcagtactgaccaacgtcaaaatcaacgacaagtgtccgagcacgggagaggcacacctcgaagaagaaaacgaaggcgacaatgcatgcaaacgcacatacagcgacaggggctggggaaacggatgcggcctgttcgggaaaggaagcatagtcgcatgcgcgaaatttacctgcgccaaaagcatgtcattattcgaggtagaccaaacgaaaatacagtatgtcatacgagcgcaactgcacgtgggcgcaaagcaagaaaactggaacacagacataaagacactaaaattcgacgccctctcagggtcgcaagaggccgagttcacaggctacggcaaggccacactcgagtgccaagtccaaacggcagtagacttcagtaactcatacattgccgagcgcgaaaaagagagctggatagtagacaagcaatgggcccaagatctcacattgccctggcaaagtggcagtggaggagtatggcgcgagatgcaccacttagtcgagttcgaaccaccacacgcggccacgataaaagtcctagccctaggaaaccaagaagggtcactaaagaccgcactgacgggtgcaatgagggtcacgaaagacacgaacaacagcaaattatacaaactccatggcggacacgtcgcctgccgcgtgaaactgtccgccctcacgctaaaaggcacaagctacaaaatgtgcacggacaaaatgtcgttcgtaaagaatccaacggacaccggacacggaacggccgtcatgcaagtaaaggtaccgaaaggagccccatgccgcatcccggtcatggtggcagacgacctaacggccgcggtcaacaaaggaatcctagtcacagtcaacccaatagcctcgacaaacgacgacgaagtgctcatagaagtaaacccgccctttggtgactcctacataatagtgggcacaggggactcgaggctgacttaccagtggcacaaggaaggaagctcaatcgggaaactattcacgcaaacaatgaagggcgcggaacgactagcggtcatgggcgacgcagcatgggacttcgggtccgccggagggttcttcacatctgtcggaaaaggaatacacacagtctttggcagcgcattccaaggcctgttcggaggactaagctggataacaaaagtaataatgggggtggtcctaatctgggtgggcataaacaccagaaacatgaccatgagcatgtccatgatccttgtaggagtaataatgatgttcctgagcttaggcgtaggcgccgaccagggatgcgcaatcaacttcggaaaa

SEQ ID NO: 926 - RNA, 2091 nt, synthetic construct
  misc_feature 1..2091: note = derived and/or modified CDS sequence (opt11) from YFV__JF912185__X-SS-prME-XX
  source 1..2091: mol_type = other RNA
atgcggggcctcagcagcagaaaaaggagaagccaggacgtactaaccgtccagttcctcatactaggaatgctgctcatggtcggaggggtgaccctcgtcaggaaaaaccgctggttactactaaacgtaactagcgaggacctcgggaaaaccttcagcgtgggaacgggcaactgcacaacgaacatcctggaagcaaaatactggtgcccagactcaatggaatacaactgcccaaacctgtcgccgcgagaagaaccggatgacatagactgctggtgttacggagtcgagaacgtcagagtcgcctacggaaaatgcgactccgcagggagaagcaggcgcagccgccgagcaatagacctgccaacacacgagaaccacggcctcaaaacacgccaagagaaatggatgacaggaagaatgggagaaagacaactacagaaaatagaaagatggctcgtgaggaacccgttcttcgctgcaaccgcactggcgatagcctacctagtcgggagcaacatgacccaacgagtagtcatcgccctgctagtactagccgtaggcccggcctacagcgcacactgcataggaataacagacagagatttcatagaaggcgtacacggaggcacgtgggtgagtgcgaccctcgaacaagacaagtgcgtgaccgtcatggcaccggacaagccatcactcgacataagtcttgaaaccgtcgcgatcgacggacccgccgaggcccggaaggtgtgctactccgcggtcctgacaaacgtcaagataaacgacaaatgccccagcacgggcgaagcccacctagaggaagaaaacgaaggagacaacgcatgcaagaggacctactcagaccgggggtggggcaacggctgcggactatttggaaaaggaagcatagtggcatgcgcaaaattcacttgcgcaaaatcaatgagcctgttcgaggtagaccaaacaaagatacaatacgtcatcagggcacaactgcacgtgggcgccaaacaagaaaactggaacaccgacatcaagacgctgaagttcgacgcactctccggcagtcaagaggctgagttcaccggatatggcagagcaacactagaatgccaggtacaaacagcagtagacttcagcaacagctacatagccgaaatggaaaaggaaagctggatagtggacaaacaatgggcgcaggacttgaccctgccctggcaatcaggaagcggcggggtatggagagaaatgcaccacctagtcgagttcgaaccaccacacgccgccacaatcaaggtcctggcactgggaaatcaagaaggaagcctaaaaaccgcgctcaccggcgcgatgagagtcaccaaagacacaaacaacagcaaactctacaaactacacggagggcacgtcgcctgccgcgtaaaattgtccgcgttgacactcaaggggacatcgtataaaatgtgcacggacaagatgtcgttcgtgaaaaaccccacggacacgggccacggcacagccgtaatgcaagtaaaagtcccgaaaggggccccgtgcagaatcccagtaatggtagcagacgacctcacagcagcagtcaacaaaggaatattagtaacagtgaatccaatcgcctcaaccaacgacgacgaagtcctgatagaagtcaacccgccgttcggcgacagctacattatcgtgggcacaggagactcaagactaacctaccaatggcacaaagaaggcagctcgatcggaaaactattcacacaaacgatgaaaggcgcagaaagactcgcggtcatgggagacgccgcatgggactttggaagcgctggaggattcttcacctccgtcggcaaaggaatccacacggtattcgggagcgcgttccaaggactattcgggggcttgagctggataacaaaagtgataatgggcgtggtgctaatctgggtcgggataaacacccggaacatgaccatgagcatgagtatgatcctagtaggggtaataatgatgttcctgtcactgggagtgggagcggaccaaggttgcgcaataaactttggcaaa

SEQ ID NO: 927 - RNA, 2091 nt, synthetic construct
  misc_feature 1..2091: note = derived and/or modified CDS sequence (opt11) from YFV__JF912186__X-SS-prME-XX
  source 1..2091: mol_type = other RNA
atgcgtggactctcgagccgaaaaaggcgaagccaagacgtcttaacagtgcaattcctcatactcgggatgcttctaatggtcggaggcgtcacattagtccgacgctcacgctggctcctgctcaacgtcacaagcgaagacctgggcaaaacattctccgtgggaacgggcaactgtaccaccaacattttagaagctaaatactggtgcccagacagcatggaatacaactgcccaaacctatcgcccagagaagaaccagacgacatcgattgctggtgctacggagtagaaaacgtacgagtagcatacggaaaatgtgacagcgccggccgctccagacgcagccgcagagcaatagacctcccaacgcacgagaaccacggcctcaaaacacgacaagagaagtggatgaccggacgaatgggcgagcgacaactccagaaaatagaacgctggctcgtaaggaacccgttcttcgccgccaccgcactcgcgattgcatacctagtcggaagcaacatgacgcaaagggtcgtgatagcgctgttggtcctagccgtgggaccggcctatagcgcgcactgcatcggaatcacagaccgcgacttcatagagggagtacacggcggcacgtgggtgagcgcaaccctagaacaagacaaatgcgtgacagtaatggcaccagacaaaccaagcctggacatcagcctggaaacggtagcgatagacggccccgccgaggcccggaaagtatgctattcagcagtactaaccaacgtcaaaatcaatgacaaatgcccgagcacaggagaagcacacctagaagaagagaacgagggcgataacgcctgcaaacgcacatactcagacaggggctggggcaacggctgcgggctattcggaaagggaagtatagtcgcgtgcgcaaaattcacatgcgcaaaatcaatgagcctgttcgaagtagaccaaacgaagatacagtacgtaattcgggcgcaactacacgtaggcgcgaagcaagaaaactggaacacggacatcaaaacgctaaaattcgacgcactttcaggctctcaagaagccgagttcacaggctacggcaaagcaaccctcgaatgccaagtacaaaccgcggtagacttcagtaactcgtacattgcagaaatggaaaaagaaagctggatagttgacaaacaatgggcccaagacctgaccctaccctggcaatcaggctcgggcggagtctggagagaaatgcaccacctggtcgagttcgaaccaccgcacgcagccacgatcaaggtcctagcactggggaaccaggaaggctcgctgaaaaccgcgctaacgggcgcgatgcgggtaacgaaggacaccaacaacagcaaactatacaaactacacggaggccacgtggcctgtcgagtaaaactatcagccctaacactaaagggtacgagctacaaaatgtgcaccgacaagatgtcattcgtcaaaaaccccacggacacgggccatggtacggccgtaatgcaagtaaaagtaccgaaaggggcaccgtgccgcatcccagtaatggtcgcggacgacctaacagccgcagtaaacaaaggcatcctggtgacggtgaaccccatagcgtcgaccaacgacgacgaagtcctcatagaagtcaatccgcctttcggtgacagctacatcatagtcggaaccggagactcgcgcctgacataccaatggcacaaggaaggatcatcaatcggaaaactattcacacaaacaatgaaaggcgcagaaaggctcgcggtcatgggcgatgccgcatgggacttcggatccgcaggaggattcttcacgtcggtcggaaaaggaatccacacagtcttcggaagcgccttccagggcctattcggaggcctcagctggataacgaaagtaatcatgggcgtggtcctcatatgggtcggaataaacacgcgtaacatgacaatgagcatgagcatgatccttgtcggagtcataatgatgttcctaagcctaggcgtcggcgcggatcaaggctgcgccataaacttcggcaaa

SEQ ID NO: 928 - RNA, 2091 nt, synthetic construct
  misc_feature 1..2091: note = derived and/or modified CDS sequence (opt11) from YFV__JF912187__X-SS-prME-XX
  source 1..2091: mol_type = other RNA
atgcgagggctctcaagccgtaagagacgaagccaagatgtactcaccgtacaattcctgatcctcgggatgctactaatggtcggaggcgtaaccttggtcaggcgaaaccgttggctactcctaaacgttacgagcgaagacctaggcaagaccttcagcgtcggcacaggcaactgtacgacaaacatcctggaggcaaagtattggtgcagcgacagcatggaatacaactgccccaaccttagcccaagggaagaacccgacgacatagactgttggtgctacggagtcgaaaacgtgcgggtagcctacggtaaatgcgacagcgcaggacgcagcaggagatccagacgagccatagacttgccgacgcacgaaaaccatgggctgaaaaccagacaggaaaagtggatgacaggaagaatgggcgagcgccagctacagaaaatagaaaggtggctggtgagaaacccattcttcgcggcaacagctctagccatcgcgtacttagtcggaagcaacatgacacaaagggtagtgatagcactcctggtcctggcggtcggtccggcgtacagcgcacactgtatcgggatcacggacagggacttcatcgagggagtacacgggggcacatgggtatcggcaaccctggaacaagacaagtgcgtaacagtcatggcacccgacaaaccaagcctggacatcagcctcgaaacagtcgcgatagacgggcccgccgaagccagaaaagtgtgctacagcgcggttctgacgaatgtgaaaatcaacgacaaatgcccaagcacgggagaagcgcatctcgaagaggaaaacgaaggcgataacgcatgcaagcgcacgtactcggacaggggatggggaaacggatgcggcctcttcggtaaagggagcatcgtggcgtgcgcaaaatttacctgtgcaaaaagcatgagcctgtttgaagtcgaccaaacgaaaatccaatacgtcattagagcgcaactccacgtaggcgcgaaacaggaaaactggaataccgacatcaagacactaaaatttgatgcgctctcaggaagccaggaggcggagttcacaggatacggtcgagccacgctggaatgccaggtccagacagcggtagacttctcgaactcatacatagccgaaatggagaaagaaagctggatcgtggataaacaatgggcccaggacctgacactcccgtggcaaagcggcagcggtggagtctggcgagaaatgcaccacctagtcgagttcgaacccccacacgcggctacgataaaggtcttggcgctgggcaaccaagaaggctcactcaaaaccgcgctcacgggcgcaatgagagtgacgaaggacaccaataactcaaaactatacaagctacacggcggacacgtagcatgcagagtaaaactgagcgcgctcacgctaaagggcacaagctacaaaatgtgcacagacaaaatgtcgttcgtcaaaaacccaacagacacggggcacggcaccgccgtaatgcaggtaaaagtacccaaaggcgccccgtgcagaataccggtaatggtcgccgacgacctcaccgccgccgtcaacaaaggaatcttagtcaccgtcaatcccatagctagcacgaacgacgacgaagtactcatagaagtgaatcccccgttcggagatagctacatcatagtagggacaggagacagcagactgacttaccaatggcacaaggaagggagcagcatcggaaaactgttcacgcaaacgatgaagggcgcagaaagactagcagtcatgggcgacgccgcgtgggacttcggaagcgcaggagggttcttcacgtcagtcgggaaagggatacacacagtgttcgggagcgcgttccaaggcctgttcgggggcctgagctggataacaaaagtgatcatgggagtagtcctgatctgggtcgggataaacactcgcaacatgacaatgagcatgagtatgatcctagtaggggtcataatgatgttcttgagcctaggcgtaggagcggaccaaggctgcgccataaacttcggcaaa

SEQ ID NO: 929 - RNA, 2091 nt, synthetic construct
  misc_feature 1..2091: note = derived and/or modified CDS sequence (opt11) from YFV__JF912189__X-SS-prME-XX
  source 1..2091: mol_type = other RNA
atgcgcggactcagcagcagaaaaagaagatcccaagacgtactaacagtacaattcctcatcctcgggatgctcctaatggtcgggggagtgaccttagtaaggcgaaaccgatggctactactcaacgtaacgtccgaagacctgggcaagaccttcagcgttggcacgggcaactgcacgacaaacatcctagaagcaaagtactggtgcccagacagcatggaatacaactgtccaaacctatcacccagggaagaacccgacgacatagactgctggtgctacggggtggaaaacgtaagagtcgcctacggcaagtgcgacagcgcaggcaggagcagacggtcaaggagagcaatagacttgccaacacacgaaaaccacggcctaaaaacgagacaggaaaaatggatgacggggcgaatgggcgaacgtcagctgcaaaagatagaacgctggttggtacggaacccgttcttcgcagcaacagcactagccatcgcgtatctagtaggaagcaacatgacgcaaagagtcgttatcgcgctcctcgtcctggcagtcggcccagcgtacagcgcacactgcataggaatcacggacagagacttcatcgaaggtgtgcacggaggaacatgggtaagcgcaaccctggaacaggacaagtgcgtaacagttatggccccggacaaaccaagcctagacataagcctggaaacggttgcgatagacggccccgccgaagcaaggaaagtgtgctactcagcagtattgacaaacgtcaaaataaacgacaagtgccccagcacgggcgaagcacacctagaagaagagaacgaaggcgacaacgcgtgcaagagaacctacagcgacagaggatgggggaacggctgcggactattcggaaaaggaagcatagtcgcatgcgccaaattcacatgcgcgaaaagcatgagcctattcgaagtggaccaaaccaaaatacaatacgtaataagagcacaactacacgtgggcgtaaaacaagaaaactggaacacggacatcaaaacgctcaaattcgacgcccttagcggatcgcaagaggcggagttcaccggatacggccgagccacactcgaatgccaggtccaaaccgcagtagacttttcaaactcctacatagccgaaatggaaaaggagagctggatagtagacaaacaatgggcacaagacctgacgctaccatggcaatcaggaagcggaggggtatggcgcgaaatgcaccatctggtcgagttcgaaccacctcacgcagctacaatcaaagttctagccctaggaaatcaagaaggctcactaaaaaccgcgctcaccggagccatgagagtaaccaaagacacaaataactccaaactatataaactacacggaggacacgtggcatgcagagtaaagctcagcgcactgacgctgaaagggacgagttacaaaatgtgcacagacaaaatgagcttcgtcaaaaaccccacggacaccggccacggcacagccgtaatgcaagtaaaggtaccaaaaggagcgccgtgccggatcccagtcatggtagcggacgaccttacagccgccgtcaacaaaggaatactcgtcacagtcaaccccatagcgtcaacaaacgacgacgaagtgctcatagaagtaaacccgccctttggcgacagctacatcatagtcggaaccggagactcgcgactcacctaccaatggcacaaggaagggtccagcatcgggaaacttttcacacaaaccatgaaaggggcagaacggctcgctgtcatgggcgatgccgcatgggacttcgggagcgccggcgggttcttcacctcagtaggaaagggcatccacacggtgtttgggagcgcgttccagggtctgttcggaggcctgagctggatcacaaaagtgatcatgggagtagtactaatatgggtcgggattaacacgaggaacatgacaatgagcatgagcatgatcctcgtcggggtcatcatgatgttccttagcttaggcgtgggcgcggaccaaggctgcgccatcaacttcggcaag

SEQ ID NO: 930 - RNA, 2061 nt, synthetic construct
  misc_feature 1..2061: note = derived and/or modified CDS sequence (opt11) from YFV__AH005112__X-SS-prME-XX
  source 1..2061: mol_type = other RNA
atgcgcggactcagcagcaggaaaagacgatcccacgacgtactcacagtacaattcctaatactcggaatgctactgatggccggaggcgtaacgctagtaaggaaaaacaggtggctcctcctcaacgtaacctccgaagacctgggcaaaacattcagtgtgggcacaggaaactgcacgaccaacatcctcgaagccaaatactggtgccccgactccatggaatacaactgccccaacctaagccccagagaagaacccgatgacatagactgctggtgctacggcgtagagaacgtacgcgtggcatacggcaaatgcgacagcgcgggtagatcacgtcgaagccgaagggcaatagaccttccgacccacgaaaaccacggactaaagacgcgccaggagaaatggatgaccggaagaatgggagagcgacaactgcagaagatagaacgctggctagtccggaacccattcttcgccgtaaccgccctcaccatagcctacctagtgggatcaaacatgacacagagagtagtgatagcgctgctcgtattagccgtgggccccgcgtacagcgcccactgtatcggcatcacagacagagactttatcgaaggcgtacacggcggaacatgggtaagcgcaacactagaacaggacaaatgcgtaacagtaatggcacccgataaaccgagcctagacatcagtcttgaaacggtcgcaatagacggaccagcagaagccagaaaagtatgctacaacgcagttctcacacacgtaaaaataaacgacaagtgcccgagcacaggagaagcccacctcgcggaagaaaacgaaggagacaacgcatgcaaacgaacgtatagcgacagaggatggggaaacggctgcggactgttcggcaaaggcagcatcgtagcatgcgcgaaatttacctgcgcaaagacaatgagcctgttcgaggtagaccaaacaaagatccaatacgtcatcagggcgcaactgcacgtcggcgcgaaacaggaaaactggaacaccgacatcaaaacactaaaattcgacgcattatccggatcacaagaagccgagttcaccggatacggaaaagccaccctcgaatgccaggtacaaaccgccgtagacttcggaaactcgtacatagcagaaatggaaaaagaatcgtggatagtggacaggcaatgggcacaagacctcacactcccctggcagtcgggaagcggcggagtatggcgcgaaatgcaccacctggtagagttcgaacccccacacgcagccacaatcagagtattggcactaggaaaccaggaaggcagcctcaagacggcactaacaggcgccatgcgagtcacgaaagacacgaacgacaacaacctgtacaaactacatggcggacacgtaagctgcagagtaaaactaagtgcactcacactaaaaggaacaagctacaaaatgtgcacagacaaaatgtccttcgtgaagaaccccacagacacaggacacggaacagtcgtgatgcaagtaaaggtccccaagggtgccccgtgcaaaatacccgtaatagtcgcagacgacctaaccgccgcgatcaacaaaggcatcctagtaacagtaaacccaatagccagcacaaacgacgacgaagtactcatcgaagtaaacccacccttcggcgacagctacataatcgtcggaacaggcgacagcagactgacataccagtggcacaaagaaggcagtagcataggaaaactcttcacgcaaaccatgcgaggacaagaaagactagcagtgatgggcgacacagcctgggacttctcgagcgcaggaggattcttcacatcaatcggcaaaggaatccacacagtattcggatccgccttccagggcctgtttggaggactgagctggataacaaaagtcatcatgggagccgtactaatctgggtgggaatcaacacaagaaacatgacaatgagcatgagcatgatcctagtcggcgtcatcatgatgttcctaagcctgggcgtcggagcg

SEQ ID NO: 931 - RNA, 2091 nt, synthetic construct
  misc_feature 1..2091: note = derived and/or modified CDS sequence (opt11) from YFV__FJ654700__X-SS-prME-XX
  source 1..2091: mol_type = other RNA
atgagaggactcagctccagaaaacgacgatcccacgacgtcctcaccgtgcaattcctcatcctcggaatgctactcatgacgggcggcgtaaccctagtccgcaaaaacagatggctactcctaaacgtaacatccgaagacctcgggaaaaccttcagcgtagggacaggcaactgcacaacaaacatcctcgaagcaaaatattggtgccccgacagcatggaatacaactgccccaatttaagccccagagaagaaccagacgacattgactgctggtgctacggtgtggaaaacgtgagagtcgcatacggcaaatgtgacagcgccggacgatcgagaaggtcccgacgagcaatcgacctgcccacccacgagaaccacggactaaagacccgccaggaaaagtggatgactggccgaatgggcgagagacaactacaaaagatagaacggtggttcgtcagaaacccctttttcgccgtcacggcacttacaatcgcctacctcgtcggatccaacatgacacaacgagtcgtcatcgcactcctcgtgctcgccgtaggaccggcttacagcgcccactgcatcggcataaccgacagggacttcatcgagggagtgcacggcggaacatgggtaagcgcgaccctagaacaggacaaatgcgtaaccgtaatggcacccgacaaaccgagcctagacatcagcctggagaccgtcgcgatcgacagaccagccgaagtacgaaaggtgtgctacaacgcagtcctcacccacgtaaaaatcaacgacaaatgcccaagcacaggagaagcacacctcgccgaagaaaacgagggcgacaacgcctgcaaaagaacctactccgataggggctggggcaacggatgcggcctcttcgggaaagggagcatagtcgcatgcgcgaaattcacctgtgcaaaaagcatgtccctgttcgaagtcgatcagacaaaaatccaatatgtaatccgcgcacaactacacgtcggcgccaaacaagaaaactggaatacagacataaaaacattgaaattcgacgccctaagcggaagccaagaggtagagttcaccggctacggcaaggccaccctcgagtgccaagttcagaccgcagtagacttcggcaactcgtacatcgccgaaatggaaaccgaaagctggatcgtagaccgccagtgggcacaagacctaaccctgccctggcaatccggaagcggcggcgtatggcgcgaaatgcaccacctcgtcgagttcgaacccccgcacgcagtaacaatcagagtgctcgctctcggcaaccaagaaggatcactcaaaacagcactcaccggcgcaatgagggtcacaaaagacacaaacgacaacaacctctacaaactccatggcgggcacgtgagctgccgcgtcaaactaagcgcactaacactcaagggcaccagctacaaaatctgcacagacaaaatgttcttcgtcaaaaatccaactgacacgggccacggcacagtagtaatgcaagtaaaagtatcaaaaggagccccgtgccgcatacccgtcatagttgcagacgaccttacagccgccataaacaaaggaatcctagtcacggtaaatcccatcgcatcaaccaacgacgacgaagtgctaatagaagtaaacccacccttcggagacagctacataatcgtaggccgaggagacagccgactcacctaccagtggcacaaagaaggcagctcaatcgggaaactcttcacacaaacaatgaaaggagtagaacgactcgccgtaatgggagacaccgcgtgggacttctcaagcgccggagggttctttaccagcgtcggcaagggaatacacaccgtcttcggcagtgcattccaaggcctgttcggaggactaaactggataacgaaagtgataatgggagcagtcctaatatgggtcggcatcaacacacgcaacatgaccatgtccatgagtatgatcctcgtgggagtcataatgatgttccttagcctaggcgtgggcgccgaccaaggatgcgccataaacttcggaaag

SEQ ID NO: 932 - RNA, 2091 nt, synthetic construct
  misc_feature 1..2091: note = derived and/or modified CDS sequence (opt11) from YFV__KM388817__X-SS-prME-XX
  source 1..2091: mol_type = other RNA
atgcgagggctgagcagccgaaaaagaaggagccaagacgtactgaccgtacaattcctaatactaggcatgctactgatggcaggcggcgtgaccctggtacgacgaaaccgctggcttctgcttaacgtaacaagcgaagacctcggaaagacattcagcgttggcacaggtaactgcacgaccaacatcttggaagcaaaatactggtgccccgacagcatggaatacaactgtcccaacctgagcccgagagaagaacccgatgacatagactgctggtgctacggcgtcgaaaacgtcagggtcgcatacggaaaatgcgacagcgcaggcagaagcaggcgatcacgacgggcgatagacctgccaacacacgaaaaccacggcctcaaaacacggcaggaaaaatggatgacaggacgaatgggagaaaggcagctgcagaaaatagaaagatggctagtaagaaacccattcttcgcggcgacggcactcacgatcgcatatctagtcggaagcaacatgacgcaaagagtggtgatagcactcctagtactcgcagtcggaccagcctactcagcgcactgcattggaatcacagaccgcgacttcatagagggcgtgcacggaggaacatgggtctctgcaaccctggaacaagataaatgcgtcaccgtcatggccccggacaaacccagcttagacataagccttgaaacagtagcaatcgacgggcccgcggaggcccgcaaggtatgctacagcgccgtcctgacaaacgtaaagatcaacgacaaatgcccatccaccggcgaagcccacctagaggaagagaacgaaggcgacaacgcctgcaaaagaacatacagcgacagaggctgggggaacggatgcggactcttcggaaaagggtccatagtggcctgcgccaaattcacatgcgctaagtcaatgagtctcttcgaagtggaccaaaccaaaatacaatacgtgatccgggcacagctacatgtcggtgcgaaacaggaaaattggaataccgacataaaaaccctaaaattcgacgcactaagcggcagccaagaggccgagttcaccgggtacgggcgagccacactggaatgccaagtccaaaccgcagtcgacttcagcaacagttacatagccgaaatggaaaaagaatcgtggatcgtagacaaacaatgggcccaagacctaacactaccatggcaaagtggatccggaggcgtatggagggaaatgcatcacctcgtggagttcgaacccccacatgcagctaccataaaggtactagccctaggaaatcaggaaggaagcctgaagaccgccctcaccggggcaatgcgagttacaaaagacacaaacaactcaaaactatacaaactgcacggcgggcacgtggcctgccgagtcaaactatcagcgctaaccctaaaggggacatcctacaaaatgtgcacggacaagatgtcgttcgtcaaaaaccccacagacacgggccacggcacggcagtaatgcaggtaaaagtaccaaagggagcaccgtgcagaataccggtcatggtagcagacgacctcacagccgccgtaaacaaaggaatcctggtaacagtaaacccaatagcaagcaccaacgacgatgaagtcctaatagaagtgaacccgcccttcggggactcatacataatcgtaggaaccggcgacagcagactaacataccagtggcacaaggaaggatcgagcatcgggaaactcttcacccaaaccatgaaaggggcagaacgcctcgcagtaatgggagacgcggcatgggacttcggatccgcaggaggattcttcaccagcgtcggaaaaggcatacacacagtattcggcagcgcattccaaggcctgttcggtggactcagctggataaccaaggtcataatgggggtagtactaatctgggtcggaataaacacacgcaacatgacaatgagcatgagcatgatactcgtcggcgtcataatgatgttcctatcactcggagtgggagcagaccagggctgcgccataaacttcggcaaa

SEQ ID NO: 933 - RNA, 2091 nt, synthetic construct
  misc_feature 1..2091: note = derived and/or modified CDS sequence (opt11) from YFV__HM582851__X-SS-prME-XX
  source 1..2091: mol_type = other RNA
atgcgcggactcagcagtagaaagcgaagatcccaagacgtactgacagtacaattcctcatactaggaatgctactgatggtcggcggcgtaaccctggtccgacgaaaccgctggctcctcctgaacgtcacgagcgaagacctaggcaaaacgttcagcgtaggaaccggcaactgcacaacgaacatattagaagcgaaatactggtgcccagacagcatggaatataactgccccaacctcagcccccgggaagaaccggacgacatagactgctggtgctacggagtagagaacgtacgggtggcatacggaaagtgcgacagcgcgggccgctcgagacgatcacggcgagcaatagacctacccacacacgaaaaccacggcctaaaaacccgacaagaaaaatggatgacaggacgaatgggtgaacggcaactgcagaaaatagaaaggtggctagtaaggaacccattcttcgcagcgacggccctcgcaatcgcctacctcgtcggcagcaacatgacacaaagggtcgtaatagcgctactcgtactagccgtaggcccagcctacagcgcgcattgcataggcatcacagacagagacttcatagagggtgtccacggcggaacctgggtgtcggcaacactagaacaagacaagtgcgtaacagtcatggcacccgacaaaccatccctagacatcagcctggaaacagtagcaatagacggaccagccgaagccagaaaagtatgctacagtgccgtactgacaaacgtaaaaatcaacgacaaatgcccaagcaccggagaagcccacctagaggaggaaaacgagggcgacaacgcatgcaaacgaacctacagcgacagaggctggggcaacgggtgtggcttattcgggaaaggaagtatcgtagcatgcgcaaagttcacgtgcgcgaagtcaatgagcctattcgaggtggaccaaaccaaaatccaatacgtaatacgggcgcaactccacgtgggagcaaaacaagaaaactggaacaccgacatcaagacattaaagttcgacgcactatccgggtcacaagaggccgagttcacaggctacggccgcgccactctcgaatgccaggtccagacggccgtagacttctcaaacagctacatagcagaaatggaaaaggaatcgtggatcgtagacaaacagtgggcacaagacttaaccctcccatggcaatcgggatctggtggggtctggcgcgaaatgcaccacctagtcgagttcgaacccccacacgcagccacaattaaagtcctggcactcggcaaccaagaaggaagtctaaaaacagccctaacaggagccatgagagtgacaaaagataccaacaacagcaaactatacaaactacacggcggacacgtcgcatgccgcgtcaaactcagtgcactaacgctaaaaggcacaagctacaaaatgtgcacggacaaaatgagcttcgtgaaaaaccccacagacacaggacacggaaccgcagtcatgcaagtaaaagtacccaaaggcgcaccatgccgcatcccagtaatggtagccgacgacctcacagccgccgtaaacaaaggcatcctagtgacagtaaacccaatagcctcaaccaacgacgacgaagtgctcatagaagtaaacccacccttcggcgacagctacataatagtagggaccggagactccagactgacctaccagtggcacaaagaagggtcctcaatagggaagttgttcacccaaaccatgaaaggtgcagaaagactagcagtgatgggagacgcagcctgggacttcgggagcgcaggcggattcttcaccagcgtaggaaaagggatccacacggtattcgggagcgcgttccagggattattcggaggcctatcctggatcacgaaggtaataatgggcgtcgtactaatctgggtaggaatcaacacccggaacatgaccatgtccatgtccatgatcctagtcggcgtaataatgatgttcctgagcctaggcgtaggggcggaccaaggctgcgcaataaacttcggaaaa

SEQ ID NO: 934 - RNA, 2091 nt, synthetic construct
  misc_feature 1..2091: note = derived and/or modified CDS sequence (opt11) from YFV__JN620362__X-SS-prME-XX
  source 1..2091: mol_type = other RNA
atgcgcggactgtcgagcagaaaaagacgatccaacgagatgacaatgatgcccctcttaatactcagcatggtcatactagccggaggcgtcaccctggtccgaaagaacagatggctcctcctcaacgtaaccgcagaagatctagggaaaacattcagcgtcggaaccggcaactgcacaacgaacattctcgaggcaaaatactggtgcccggacagcatggagtacaactgccctaatctcagcccccgagaggagcccgacgacatagactgttggtgctacggcgtcgaaaacgtacgcgtagcctacggacgctgcgacgccgtaggccgaagtaaacgcagcagacgagcaatagacctgcccacacacgaaaaccacggcctaaaaacccgacaggagaaatggatgacaggacggatgggagaaaggcaactacagaaaatcgaacgatggctggtgaggaacccattcttcgccataaccgcactcgcaatcgcatacctggtcggaaacaacatgacgcaaagagtagtaatagcactcctcgtcctggcggtcggaccagcctacagcgcacactgtattggaatcacagacagagacttcatcgaaggagtacacgggggcacctgggtcagcgccacactggaacaagacaagtgcgtaaccgtaatggcacccgacaaacccagcctagacataagcctccaaacagtcgcgatcgacggccccgccgaagcaagaaaagtgtgctacagcgcagtactgacacacgtcaaaatcaacgacaaatgcccatcaacaggagaagcccacctagccgaagaaaacgacggcgacaacgcctgtaaacgaacctactcagaccgagggtggggcaacggatgtggcctgtttggaaaaggatcaatagtcgcctgcgcgaaatttacctgcgccaaatcgatgtcactcttcgaagtcgatcaaacgaaaatacaatacgtaatacgagcccaactccacgtaggagccaaacaagagaactggaacacagacataaagacgctaaagttcgacgccctatcagggtcccaagaggcagaatttacaggatatggaaaggccacactggaatgccaagtacaaaccgcagtcgacttcggaaacagttacattgcagaaatggaaaaagacagctggatagtagaccgccaatgggcgcaagacctaacactgccctggcaatcaggcagtgggggaatctggcgcgaaatgcaccacctagtcgagttcgagcccccacacgcagcaacaatccgagtgttggccctaggcaaccaagagggctcgttaaaaacagccctaacaggcgcgatgcgtgtaacaaaagacgaaaacgacaacaacctctacaaacttcacgggggacacgtaagctgccgcgtaaaactatcggcactaacgctcaaaggcacgagctacaaaatgtgcacagacaagatgtcgttcgtgaaaaacccaaccgacacggggcatggaaccgtagtcatgcaagtgaaagtaccaaaaggagccccatgcaaaatccccgtcatagtggccgacgacctgaccgcagcagtaaacaaaggcatactcgtgacggtaaacccaatagccagtactaacgacgacgaagtgctaatagaagtaaacccgcccttcggcgacagttatataatagtaggcacaggagactcacgactgacctaccaatggcacaaagaagggagctcgataggcaaactatttacacaaaccatgaaaggcgcagaaagactcgcagtaatgggcgatgcagcgtgggacttctcgagcgcaggcggcttctttacgagcgtcgggaaagggattcacacagtcttcgggagcgcattccaaggactgttcggcggactctcctggatcaccaaggtaataatgggagcagtactaatctgggtaggcataaacaccagaaacatgacgatgagcatgagcatgatcttagtgggagtaatcatgatgttcctaagcctgggtgtgggggcagaccaaggatgcgcagtaaacttcggaaaa

SEQ ID NO: 935 - RNA, 2091 nt, synthetic construct
  misc_feature 1..2091: note = derived and/or modified CDS sequence (opt11) from YFV__JN811142__X-SS-prME-XX
  source 1..2091: mol_type = other RNA
atgcgaggactctcaagcaggaaaaggcgatcacatgatgtcttgaccgtgcaattcctcatactcggtatgttgctgatgaccggaggagttaccttggtccgcaaaaatagatggctactactcaacgtaacatcagaggacctaggaaaaactttcagcgtgggaacggggaactgcacaacaaacatactagaagcaaaatactggtgtccagatagcatggagtacaactgtccaaacctctcacccagagaagaacccgacgacatagactgctggtgctacggcgtcgaaaacgtaagagtggcctacggcaagtgcgacagcgcgggccggagcagacgatcgagaagggccatagaccttccaacacacgagaaccacggcctgaaaacccgccaagaaaaatggatgacagggagaatgggagagcgtcagctacagaaaatagaaaggtggttcgtgaggaacccgttctttgccgtaaccgcactcacaatcgcatacctggttgggagcaacatgacacaacgagtcgtgatcgcactactggtcctagctgtgggaccggcctacagtgcacactgcatcggaatcacggaccgagacttcatcgagggcgtgcacgggggcacgtgggtaagcgcgacactggaacaagacaagtgcgtgacagtaatggcacccgataaaccaagcctggacatatcactagaaacggtcgcaatcgaccggccagccgaggtaaggaaggtatgctacaacgcagtactgacccatgtaaagatcaacgacaagtgcccgagcacgggagaagcccatcttgccgaagagaacgagggggataacgcgtgcaagcgcacatactcagaccggggatggggaaatggatgcggcctcttcgggaaggggagtatcgtagcatgcgcgaagttcacatgcgccaaaagcatgagcctcttcgaggtagaccaaacaaaaatccaatacgtaatacgagcccaactgcacgtgggcgcaaagcaggaaaactggacgaccgacatcaagacattgcgttttgatgcgctatccggctcacaagaggtagagttcatcggctacggtaaggccacgctcgagtgccaggtacagaccgcggtcgacttcgggaactcgtacatagccgagatggagaccgaaagctggatcgtggacagacaatgggcacaggacctaaccctgccgtggcaatcaggatcgggaggggtctggcgagaaatgcaccacctggtcgagttcgaaccgccgcacgcggccacaatcagggtactagcactaggcaaccaagagggctcgctcaaaaccgcgctcacgggcgcgatgagggtcacaaaagacacaaacgacaacaacttatacaagctccacggaggacacgtgagctgccgtgttaagctgagcgcactcacgctgaagggcacgagctacaaaatatgcaccgacaagatgttcttcgtcaaaaatccgacagacacaggtcatggcacggtagtgatgcaggtcaaggtctcgaaaggagccccgtgcagaatcccggtcatagtggcggacgacctcaccgccgcgataaacaaaggcatcctggtgaccgtcaaccccatagcctcgacaaacgacgacgaagtgctcatagaagtcaacccgccattcggcgacagctacatcatagtaggaagaggggactcgcgactgacatatcaatggcacaaggaagggagctcaatcggaaaactgttcacacaaacgatgaaaggagtcgagcggttagccgtcatgggcgacaccgcatgggacttctcgagcgcgggagggttcttcacctcggtggggaaaggcatccacacggtcttcggaagcgcgttccaaggactattcgggggactgaactggataacgaaagtgataatgggggcggtactgatatgggtaggaataaacaccaggaacatgaccatgagcatgagcatgattctagtcggagtaataatgatgttcctaagcctgggcgtaggcgcggaccaaggctgcgcaataaacttcggaaag

SEQ ID NO: 936 - RNA, 2091 nt, synthetic construct
  misc_feature 1..2091: note = derived and/or modified CDS sequence (opt11) from YFV__DQ100292__X-SS-prME-XX
  source 1..2091: mol_type = other RNA
atgcgcggactctcgagcaggaaacgacgttcgcacgatgtcctaaccgtacagtttctgatactcgggatgctactaatgaccggaggcgtaaccttggtcaggaaaaaccgatggctcctactcaacgtcacatcggaagacctaggaaagacgttcagcgtaggaacgggcaactgcacaacaaacatcctggaagcaaaatactggtgtccagacagcatggagtacaattgtcccaacttatcgcccagggaggaacccgacgacatcgactgctggtgctacggagtagaaaacgtgcgcgttgcttacggcaagtgcgacagcgcaggacggtccagaagatcgcgccgagctatagacctgcccacgcacgaaaaccacggcctaaaaacacgccaagagaaatggatgacgggacgaatgggagaacgccagctccagaaaatcgaaagatggttcgtacgaaacccgttcttcgcagtaaccgcactcacaatagcctacttggtcgggtccaacatgacgcaacgggtcgtgatcgcactactcgtcctagcagtgggcccagcatactccgcgcactgcataggaataacagaccgggacttcatagaaggcgtacacggaggcacctgggtcagcgcaaccctggagcaagacaagtgcgtaacagtaatggcacccgacaaaccgagcttggacataagcctcgaaacagttgctatagaccgcccagccgaagccagaaaagtatgctacaatgcagtcctaacccacgtaaaaataaacgacaagtgcccaagcacgggagaagcccacctagcagaggaaaacgaaggagacaacgcctgcaaacgcacctactcagacagaggatggggaaacggttgcggactcttcgggaaagggagcattgtagcgtgcgcgaaattcacatgcgctaaatcaatgagcctattcgaagtagaccaaacaaaaatacagtacgtgatccgagcgcaactacacgtcggagcgaagcaggagaattggaatacagacatcaagaccctcaaattcgacgcactcagcggatcgcaagaggtagagttcatcggctacgggaaagcaacactcgaatgccaagtacaaacggcggtagacttcggaaacagctacatcgccgaaatggaaacggaaagctggatcgtggaccgacagtgggcccaagacctaaccctcccctggcaatcgggctccggaggcgtctggcgcgaaatgcaccacctcgtcgaatttgaaccaccacacgcggcgacaataagagtcctcgccctaggcaatcaagaaggctcgctcaagacagcactaaccggagccatgagagtcacaaaagacaccaacgacaacaacttatacaaactccacggcggacacgtaagttgccgagtgaaactaagcgccctcacgctcaagggaaccagttacaaaatctgcaccgacaaaatgtttttcgtgaaaaacccaacggacacaggacacggcaccgtagtaatgcaagtaaaagtcccaaaaggcgccccgtgccgcatacccgtaatagtagccgacgatctgacggccgcagtaaacaaagggatcctagtaacggtaaaccccatagccagcaccaatgatgacgaagtgctaatagaagtaaacccaccatttggagacagctacataatagtaggacgaggcgactcgcgcctcacctaccaatggcacaaagaaggatccagcatcggaaaactattcacgcaaacgatgaagggagtcgaaaggctagcagttatgggcgacaccgcgtgggacttctcgagcgcaggcgggttcttcacctcagttggaaaaggcattcacacagtatttggaagcgcattccagggactcttcggtggattaaattggatcacaaaagtgataatgggcgcagtattgatttgggtagggatcaacaccaggaacatgacaatgagcatgagcatgatcttagtaggggtcataatgatgttcctatcactgggagtcggagctgaccaaggatgcgcaataaacttcggcaag

SEQ ID NO: 937 - RNA, 2091 nt, synthetic construct
  misc_feature 1..2091: note = derived and/or modified CDS sequence (opt11) from YFV__DQ118157__X-SS-prME-XX
  source 1..2091: mol_type = other RNA
atgagaggcctcagcagccgaaaaaggagaagccacgacgtactcacagtccagttcttgatcctcggcatgctactgatgaccggcggcgtcaccctagttagaaagaaccgatggctactcctaaatgtaacatccgaagacctaggcaaaaccttctccgtaggaacagggaactgcacgaccaatatcctagaagccaaatactggtgcccggacagcatggagtacaactgccccaacctcagcccccgagaggaacccgacgacatcgactgctggtgctacggcgtagaaaacgtccgcgtagcatacggaaaatgtgactccgcgggccgatctcgacgcagccgccgcgccatcgacctaccaacacacgaaaaccacggactaaaaaccaggcaggaaaaatggatgaccggacggatgggcgaacgacaactccaaaagatcgaaagatggttcgtccgaaaccccttctttgccgtaacggccctcaccatagcatacctagtcgggtccaacatgacacaacgcgtagtcatcgccctcctcgtcctagcggtgggcccagcctacagcgcacactgcatcgggataacagaccgagacttcatcgaaggcgtccacggcggcacctgggtctctgccaccctcgaacaagacaagtgcgtaacggtcatggccccagacaaaccaagcctagacataagcctagaaacggtcgcaatagacagaccggccgaagtgaggaaggtatgttacaacgccgtactcacacacgtaaaaataaacgacaagtgcccaagcaccggcgaagcccacctagcagaagaaaacgaaggcgacaacgcatgcaaaagaacctactccgacagagggtggggcaacggctgcggcctcttcggcaaaggaagcatcgtagcctgcgcaaaattcacatgcgcgaaaagcatgagtctatttgaagtggaccaaacgaaaatacaatatgtaatccgagcacaattacacgtaggcgcgaaacaggaaaactggaacacagacatcaagacattaaaattcgacgcactaagcggcagccaagaagtagagttcatcggatacgggaaggccacactcgaatgccaagtccaaaccgcagtcgacttcggaaactcatacatagccgaaatggaaaccgaatcctggatcgtcgaccgccaatgggcacaagacctaaccctgccatggcaaagcggctcaggaggagtatggcgcgaaatgcatcatcttgtcgagtttgaaccaccccacgccgcaacaatacgcgtcctagccctcggaaaccaggaaggcagcctgaaaaccgcactaaccggcgccatgcgagtcacaaaggacacgaacgacaacaacctctacaagctccacggcggacacgtcagctgccgcgtcaaacttagcgcgctcacgctcaagggaacaagctacaaaatctgcacagacaaaatgttcttcgtcaaaaacccaacagatacaggccacggcaccgtcgttatgcaggtcaaagtgagcaaaggcgcaccctgccgcatacccgtcatcgtagccgacgacctaacagcagcgatcaacaaaggcattctcgtcaccgtcaacccaattgcaagcaccaacgacgacgaagttctaatagaggtcaacccgcccttcggagactcctacatcatagtcggccgaggcgactcaagactaacctaccaatggcacaaagaaggatcaagcatcggaaaactcttcacacagaccatgaaaggcgtcgaacgactcgcggtaatgggggataccgcttgggacttcagtagcgcaggaggattcttcacctcagtgggcaaaggaatccatacagtatttggcagcgccttccaaggcctcttcggcggactaaactggataacaaaggtaatcatgggagcagtcctaatctgggtcggaataaacaccagaaacatgaccatgagcatgagcatgatactggtaggcgtcataatgatgttcctaagtctcggagtgggagccgatcaaggatgcgccatcaacttcgggaaa

SEQ ID NO: 938 - RNA, 2091 nt, synthetic construct
  misc_feature 1..2091: note = derived and/or modified CDS sequence (opt11) from YFV__DQ235229__X-SS-prME-XX
  source 1..2091: mol_type = other RNA
atgataggcctaagcagccgcaaaaggcgatcaaacgaaatggcaatgatgcccctactcattctcagcatggtcatcctcgcgggaggggtgaccctggtccgcaaaaacagatggctacttctgaacgtaacagccgaagaccttggaaaaacattcagcctaggcacaggaaactgcacgaccaacatacttgaggcgaagtactggtgcccagacagcatggaatacaactgccccaacctaagtccccgagaggagccagacgacatcgactgctggtgctacggagtggagaacgtccgagtcgcctacggacggtgcgacgccgtgggcagaagcaaacgatcgcgaagggcaatcgatctgccaacacacgaaaaccatgggctaaaaactcgacaagaaaaatggatggcgggaagaatgggagaaagacaacttcagaaaatagagcgctggctcgtaagaaacccattcttcgcaatcacagcactcgcgatagcatacctcgtaggcaacaacatgacacaacgagtcgtaatagccctactcgtcctcgccgtaggaccagcctacagcgcacactgcataggaatcaccgaccgagacttcatagagggcgtgcacggtggaacgtgggtgagcgccacactagaacaaggcaagtgcgtaaccgtaatggcacccgacaaacccagcctagacataagcctacaaacagtagcaatcgacggccccgcagaagcaaggaaagtatgctattcagccgtactcacccacgtcaaaataaacgacaaatgccccagcaccggtgaagcccacctcgccgaggaaaacgacggtgacaacgcgtgcaaacgaacgtacagcgaccgaggctgggggaacggctgtggtctgttcggaaagggaagcatagtcgcatgcgccaaattcacatgcgcaaaaagcatgagcctattcgaagttgaccaaaccaaaatacaatacgtcataagagcacaactacacgtaggcgcaaaacaagagaactggaacacagacatcaaaaccctcaaattcgatgcactgtcaggcagccaagaagcggagttcacaggctacggcaaagcaacactcgaatgccaagtccagacagcagtggacttcgggaactcgtacatagcggaaatggaaaaggacagctggatagtcgacagacaatgggcacaagatctgaccctgccatggcaatccggctccggaggcatctggagagagatgcaccatctagtcgagttcgaaccaccacacgcagccaccatccgcgtcttagcgctaggtaatcaagaaggaagcctaaaaacagccctgacaggggcgatgagggtcaccaaagacgaaaatgacaacaacctgtacaagctacacggcgggcacgtaagctgccgagtcaaactatcagcactcaccctaaaaggcacatcatacaaaatgtgcacagacaagatgagcttcgtcaaaaaccctacagacacaggccacggcacagtagtaatgcaagtcaaggtcccgaaaggagcgccgtgcaaaataccagtcatagtcgcagacgacctaacagcagcggtaaacaaaggcatcctagttacagtaaacccgatcgcatcgacaaacgacgacgaagtcctgatcgaggtaaatcccccattcggagatagctacataatcgtcggcacgggagactcacgactcacataccaatggcacaaggaagggagctcaataggcaagctattcacgcaaacgatgaagggagcagaacgactagcagtcatgggcgatgcggcctgggacttcagcagcgccggcggattcttcacctcagtgggcaaaggcatccacaccgtattcggatctgcattccaaggcctcttcggcgggctctcctggataacaaaagtaatcatgggagccgtcctaatctgggtgggaatcaacacccgaaacatgactatgagcatgagcatgatcctggtaggcgtcataatgatgttcctcagcttaggtgtcggcgccgaccaaggctgcgccgtcaacttcggcaaa

SEQ ID NO: 939 - RNA, 2088 nt, synthetic construct
  misc_feature 1..2088: note = derived and/or modified CDS sequence (opt11) from YFV__DQ322633__X-SS-prME-XX
  source 1..2088: mol_type = other RNA
atgggcctcagctccagaaaaagacggagccacgacgtactaacggtacagttcctaatcctcggaatgctattaatgaccggcggagtcacactcgtcaggaagaaccgatggttactactaaacgtaacatcagaagacctcggaaaaacattcagcgtagggacaggcaactgcaccacaaatatactcgaagcgaagtactggtgccccgacagtatggaatacaactgcccaaacctatcccccagagaagaaccagacgacatagactgctggtgctacggagtggaaaatgtccgcgtcgcgtacggcaaatgcgactccgcaggccgaagcagaagaagccgacgagcgatagacctgccaacgcacgaaaaccacggccttaaaacgcgacaagaaaaatggatgacgggaagaatgggagaacggcagctacagaaaatagagcgatggttcgtgcgaaacccattcttcgcggtgacggctctcacaatcgcctatctggtaggctccaacatgacccaaagggtcgtaatcgcactactcgtcctagcggtaggaccagcgtacagcgcccactgcatcggcatcacggacagagactttatcgaaggagtacacggaggaacatgggtcagcgcaaccctcgaacaagacaaatgcgtaaccgtaatggcgccggacaaaccatcactcgacatatcattggaaacagtcgcaatcgaccggccagcggaagtaaggaaagtatgctataacgccgtcctaacccacgtcaaaatcaatgacaagtgccccagtacaggcgaggcacacctcgcggaagaaaacgaaggagacaacgcctgcaaacgcacctacagcgacagaggatgggggaacggatgcggactattcgggaaaggaagcatcgtcgcgtgcgccaaatttacctgcgcaaaaagcatgtcactattcgaggtcgaccaaaccaaaatacagtacgtaataagagcacaactccacgtaggcgcaaaacaagaaaactggaacacagacatcaaaacactaaaattcgacgccctttcaggcagtcaagaagttgagttcatcggatatggaaaagcaacactcgaatgccaagtccagacggccgtggacttcggaaacagctacatcgccgaaatggaaacagaaagctggatcgtcgaccgacaatgggcacaagacctcaccctaccgtggcagagcggcagcggcggagtatggcgggaaatgcaccacctagtagagttcgaacccccgcacgccgcgacaatacgggtcctggccctgggaaaccaagaaggtagcctaaaaacagcactaacaggagcaatgcgagtaacaaaagacacaaacgataacaacctctacaaactacacggcgggcacgtcagctgccgagtaaaactcagcgcactaacactgaaagggaccagctacaaaatatgcacggacaaaatgttcttcgtcaaaaacccaaccgacacaggccacggtaccgtagtaatgcaggtcaaggtgagcaaaggagcaccctgcaggatccccgtaatcgtggcggacgacctcacggcagccataaataaaggaatactcgtaaccgtaaaccccatagcctccaccaacgacgacgaagtactaatcgaagtaaaccctcccttcggagacagctacataatagtcggacgcggagacagccgattaacataccagtggcataaagaaggatccagcataggcaaactattcactcagaccatgaaaggcgtagaaagactcgcggtcatgggagacacggcatgggacttcagctcagccggaggattcttcaccagcgtcggaaaaggaatccacacagtgttcggctccgcgttccaaggcctcttcggaggactaaactggataacaaaagtaatcatgggagcggtactcatctgggtcggaataaacacccggaacatgaccatgagcatgtcaatgatcctggtaggcgtcataatgatgttcctatcacttggcgtcggcgcggaccaaggctgcgcgatcaacttcggcaaa

SEQ ID NO: 940 - RNA, 2067 nt, synthetic construct
  misc_feature 1..2067: note = derived and/or modified CDS sequence (opt11) from YFV__DQ322634__X-SS-prME-XX
  source 1..2067: mol_type = other RNA
atgagaagccacgacgtcctgaccgtacagttcctcatattaggaatgctgctcatgaccgggggagtgaccctagtcaggaaaaatagatggctacttctcaacgtaacaagcgaagatctaggcaaaacattcagtgtgggaaccggaaactgcacaacaaacatactggaagcaaagtactggtgcccggacagcatggaatacaactgccccaacctaagccccagagaagaacccgacgacatagactgctggtgctacggagtcgaaaacgtgcgagtagcctacggcaaatgcgacagcgctggcagatccaggaggtcacgcagagccatagacctgccgacacacgaaaaccacggactgaaaacgagacaggaaaaatggatgacagggcgaatgggcgaacgccaactgcagaaaatcgagaggtggttcgtaaggaacccattcttcgcagtaaccgcactcacgatcgcctatctagtcggcagcaacatgacacaaagagtggtaatagcacttctagtcctagcagtaggaccagcctacagcgcgcactgcatagggatcacagatagagacttcatcgaaggggtgcacggcggcacgtgggtcagcgcaaccctcgaacaagacaaatgcgttaccgtgatggcgccagataagccgagcctagacataagcctcgaaacagtcgcgatcgaccgaccagccgaggtacggaaggtatgctacaacgcagtactgacccacgtaaaaataaacgacaaatgcccgagcacgggcgaagcccatctcgccgaagaaaacgaaggcgacaacgcatgcaaacgcacgtactcagacaggggctgggggaacggctgcggactattcggaaaaggtagcatcgtcgcatgcgctaaattcacatgcgccaaaagcatgagcctgttcgaggtcgatcaaacaaaaatacaatacgtaatacgggcgcaactacacgtaggagccaaacaagagaactggaacacagacataaaaacactcaagttcgacgcgttaagcggatcacaggaagtagagttcatcggctacggcaaagcaacactcgagtgccaagtccaaacagccgtcgacttcggaaattcctacatagctgaaatggagaccgagagctggatcgtagacaggcagtgggcccaggacctcacactcccatggcaaagcggatcaggaggggtctggcgagaaatgcaccacctggtcgagttcgagccgccacacgccgccaccataagggtcctcgcactgggcaaccaagaaggcagcctaaaaacagcactcacgggagcaatgagagtcacgaaagacacaaacgacaacaacctctacaaactacacggaggacacgtatcatgcagagtgaaactaagcgcactgacactaaagggaacgagctataaaatatgcaccgacaaaatgttcttcgtcaaaaacccaactgacaccggacacggtaccgtagtaatgcaggtaaaagtatcaaaaggggccccgtgccgaatacccgtaatagtagcagacgacctaaccgccgcaatcaacaagggaatcctcgtgacagtcaaccccatagcctccacaaacgacgatgaagtgctcatcgaagtaaacccgccattcggcgactcatacataatagttggacgcggagattcccgactgacctaccaatggcacaaggaagggagctcaatcggcaaactattcacgcaaacgatgaaaggcgtggaacgactcgcggtcatgggcgatacagcatgggacttcagtagcgcaggcggcttcttcaccagcgtcggaaaggggatccacaccgtgttcgggagcgcattccaaggcctattcgggggcctaaactggattacaaaagtaatcatgggagccgtcctaatatgggtcggaatcaacaccagaaacatgaccatgagcatgagcatgatcttggtgggagtcataatgatgttcctgagtctgggagtaggcgcagaccaaggctgtgcgatcaacttcggaaag

SEQ ID NO: 941 - RNA, 2061 nt, synthetic construct
  misc_feature 1..2061: note = derived and/or modified CDS sequence (opt11) from YFV__DQ322642__X-SS-prME-XX
  source 1..2061: mol_type = other RNA
atgcgcgggctcagcagccgaaagaggcgctcgcacgacgtactaaccgtgcaatttctcatcctgggaatgctgctcatgaccggaggagtaaccctagtccgaaagaacagatggctcctcctcaacgtaacgtcggaagacctaggaaaaacattcagtgtaggcaccgggaactgcacaacgaacatcctagaagcaaaatattggtgccccgacagcatggaatacaactgcccaaacctatcaccaagagaagaaccggacgatatcgattgctggtgctacggagtcgaaaacgtgcgcgtggcctacgggaaatgcgacagcgcgggccggagtaggagatcgcgccgggcaatagacctaccgactcacgaaaaccacggactaaaaacacgccaagaaaagtggatgaccggccgaatgggcgaaagacaactccagaaaatagaaagatggttcgtaagaaacccattcttcgccgtgacagcactcaccattgcatacctagtcggatccaacatgacccaacgagtagtgattgcgctcctagtattggccgtcggaccggcctacagcgcgcactgcatcggaataacagacagggacttcatagagggggtacacggaggaacgtgggtgagcgcaacactcgaacaagacaagtgcgtcacagtcatggctcccgacaaacccagcctagacatatccctagaaacggtagcaattgaccgcccagccgaggtacggaaggtatgctacaacgcagtactgacccacgtaaagatcaacgacaagtgcccgagcaccggcgaagcccatctagcagaggaaaacgagggcgacaacgcttgcaaacgaacgtacagcgacagaggctggggaaacggctgcggattattcggaaaagggagcatagtagcgtgcgccaaattcacatgcgccaaaagcatgagcctattcgaagtagaccaaacaaaaatccaatacgtgatacgagcacaactacacgtcggagcgaagcaagaaaactggaacaccgatataaaaacactaaagttcgacgcattatcaggctcacaagaagtagaatttataggctacggcaaggccacactcgaatgccaagtacagaccgccgtagacttcggcaactcgtacatcgcagaaatggaaacagagagctggatcgtggacagacagtgggcacaagacctgacactaccctggcaatcaggatcgggaggcgtatggcgagaaatgcaccacctagtcgagttcgaacccccgcacgcagccacgatcagagtcctggcactaggcaaccaagaaggctcattaaaaaccgcactaacaggagccatgagggtaaccaaagacaccaacgacaataacctatacaaattacacggaggccacgtgtcatgccgggtaaaactaagcgccctcaccctaaaaggtacatcatacaagatatgcacggacaaaatgttcttcgtcaaaaaccccacagacacaggacacggcacagtcgtaatgcaggtcaaggtatcaaaaggcgccccatgccggatcccagtcatagtggcagacgacctaactgccgcgatcaacaaagggatattagtcacagtaaaccccatcgcctcgaccaacgacgacgaagtgctaatagaagtgaaccctcccttcggggacagttacatcatagtaggacgcggggatagccgcctaacataccaatggcacaaggaaggcagcagtatcgggaaactattcacgcaaacaatgaagggagtagaaagactagcagtcatgggcgacacagcatgggacttcagcagcgcaggcggattcttcacctcggtcggcaaaggcatacacaccgtattcgggagcgcgttccaagggctattcgggggcctgaattggataacaaaggtaataatgggagcggtcctgatatgggtagggataaatacaagaaacatgaccatgagcatgagtatgatcctggtgggggtaataatgatgttcctaagcctcggagtaggcgcg

SEQ ID NO: 942 - RNA, 2091 nt, synthetic construct
  misc_feature 1..2091: note = derived and/or modified CDS sequence (opt11) from YFV__GQ379162__X-SS-prME-XX
  source 1..2091: mol_type = other RNA
atgcgcggcctcagcagcagaaaacgacgctcgcacgacgtactaacggtccaatttctaatactaggaatgctactcatgacgggaggagtaaccctagtaagaaagaatcgatggctacttctcaacgtcacaagcgaagacctcggcaaaacattcagcgtaggaacggggaactgtacgacaaacatacttgaagccaaatactggtgtcccgatagcatggaatacaactgcccaaacctatccccgagagaagaaccagacgacattgattgctggtgctacggcgtagagaacgtgcgcgtagcctacggcaaatgcgatagcgcaggcaggtcaaggcgcagccgcagagcaatagacctaccaacccacgaaaaccacggcctaaaaacccgacaagaaaaatggatgacaggacgcatgggagagcgccaactccagaaaatcgaacgctggttcgtccgcaacccattcttcgcagtcacagcactaacaatcgcatacctagtaggatccaacatgacccaacgagtcgtcatagcgctcctagtactcgcagtaggcccagcctactccgcgcactgcatcgggatcacagacagggacttcatcgaaggagtccacggaggcacgtgggtgagcgcaaccctcgaacaagacaaatgcgtgaccgtcatggcacccgacaagccaagcctagacataagcctcgaaaccgtcgcaatagatcgcccagcagaagccagaaaagtctgttataacgcggtactaacccatgtaaagatcaacgacaaatgcccatccacaggagaagcacacctcgcggaggaaaacgaaggcgacaacgcatgcaaaagaacatactcggatagaggctggggaaacggatgcggcctattcgggaaaggcagcatcgtcgcctgcgccaaattcacatgcgcgaagtccatgtcactattcgaggtagaccaaacaaaaatacaatacgtcatacgcgcccaactacacgtaggagcaaaacaagaaaactggaatacatccatcaaaacgcttaaatttgacgcgctaagcggatcacaagaagttgagttcataggctacggaaaggcaacactagaatgccaagtccaaacagcagtcgattttgggaactcatacatagccgaaatggaaacagagagctggatcgtagaccggcagtgggcccaagaccttaccctcccatggcaatcaggatcgggaggagtttggcgtgaaatgcaccacctagtcgagttcgagccaccacacgcagccacaatcagagtactagccctagggaaccaagaaggctcactgaaaactgcgctcacgggggcaatgagagtcacaaaagacaccaacgacaataacctatacaaactgcacggcgggcacgtcagctgccgagtaaagctcagcgctctaaccctgaaagggacaagctacaaaatatgcaccgacaaaatgttcttcgtcaaaaaccccactgacacgggccatggcaccgtagtcatgcaagtcaaagtcccgaaaggagccccctgccgaatcccggtcatagtcgcggacgatctcacggccgcaattaacaaagggattctagtaacggtcaacccaatagcaagcacaaacgacgacgaagttctcatagaggtcaacccgccattcggagactcatacatcatagtgggacggggagactcacgcctcacataccaatggcataaagaagggagcagcatcggaaaactcttcacccaaacaatgaaaggcgtagaaaggctagcagtaatgggagacgtcgcatgggacttcagctccgcaggcgggttcttcacctccgtgggaaaaggcatccacacagtgttcggcagcgcattccagggactgttcggaggcctgaactggataacgaaagtaatcatgggcgcagtactcatctgggtcgggatcaacaccaggaacatgacgatgagcatgagcatgatacttgtcggggtcataatgatgttcctaagtctaggagtaggcgccgaccaaggctgtgccataaactttggcaaa

SEQ ID NO: 943 - RNA, 2085 nt, synthetic construct
  misc_feature 1..2085: note = derived and/or modified CDS sequence (opt11) from YFV__DQ859065__X-SS-prME-XX
  source 1..2085: mol_type = other RNA
atgctaaaaggagtaagcggccggaagaaacgacgcagcgtcgaggccacaggattcgtaagcacactcctattcggcatagtgcttacagcctccgtcagcaggcacgcacaccacaccctcctcaatgtgacaaaagaggacacaaaccaaatactaacactacgcaacggcaactgcacagtagtatcaatggacgtagggagctggtgtgatgacaacgtcgaatacgactgcgtaacactccaagacaacgaagaaccagacgacgtggactgctggtgctacaaagtaaacggcgtccgggttacctacggaaaatgcagagaaggaaacacaccacgccgatccaaacgcgcagtggtgataacagcacacctggaccaaggcctgaccaccaaaaaggagacatggctaggcagcagccacttcgaaacccagatacagaaaatagaaaagtggataatccgcaaccccacctacgccatcgcagctataatcatggcctggtacataggaaacagcacaaaacaacgcgtggtgctgctgctcctaacactcgcactaggcccagcctatgccacacactgcgtcggcatagcaaagagagatttcgtccaaggcgtccaaggcaccacctgggtaaatgtggtaatggaacaaggcgcatgtgtaaccatcgtaaccgaaggcaaaccaagcgtagacgtctggatggaaggaatcacattcagctcaccaaccatggtacggcgcatatcccacacagcaacaatctccgacacaaaaatcagctcagcatgccccagcacgggagaggccaagctagacgaagaacacgacaagacattcgaatgcaaacgaacatacagcgaccgcggatgggggaacggctgcggcctcttcggaaaaggatccatcgtagcgtgcgcaaaattcacatcgaccgggcacatggacgtatacgaaatggacatgaccaaggtcgaatatacaatcaaaacgcaagtacactccggcgccaagtcggacgacaccacaggcgttaaggaaataaaattcacccccgtcagcggaacccaaacggtggagttcccaggctacggcaacctggggctagaatgcatagtacaatcagacatcgatttcaccacacactacctcgtcgtactaggcacagatgcgtggctggtacacaaagcctgggtagaagacgtgacactaccatggaagcacgaaggagccgccagctggcgcgacaaacaatacctagtcgagttcggcgaaccgcacgccgccacaataaaagtcctagtcctcggaagccaggaaggagccctacgcaccgcactagccggagcgatgatggtaacacacgactcaagcgcaaaaacattcaagctccacggaggacacgtgacatgtaaagccaaactcaacgacctagtaatcaagggcaccacatacaccaactgcagaggcggcctcagtttcgtaaaaacaccaacagacacaggtcacggcacagtcgtaatgcaggtcaaagtatcacgcaatgccccatgcagactaacagtcatagccgcagacgatgccagcggacacgtaaaccgcggcaccctagttacgagtaaccctatagctaacagcaacaacgatgaagtactcgtagaagtaaacccaccttacggcagcagttacctcatcgtcgggacgggcgacgacaaattagtataccagtggaagaaaagcgggagctccatcggaaaactattcagtgaaacagtaaaaggcgcacaacgaatggccatcgtcggctccagtagctgggatttcagcagcgccggtggcttcttctcctcggtcggcaaagcactacacaccgtgttcggaacagccttccaagggatattcggcggcctcagctggatcacacgcgtactaataggtgtccttctaatatggctgggcctcaactcccgaaacggcatggcaactaccgtaatgatgataaccggcttcgtgatcctattcctgtccctcggtgtgggcgcggaaataggctgcagcgtcaactggggccag

SEQ ID NO: 944 - RNA, 2091 nt, synthetic construct
  misc_feature 1..2091: note = derived and/or modified CDS sequence (opt11) from YFV__KU921608__X-SS-prME-XX
  source 1..2091: mol_type = other RNA
atgcgaggtctggcaagccgaaaacggcgaagcaacgaaatggcgctattcccactacttctgctcggactgctcgcactctccggcggcgtcacactcgtaagaaagaaccgatggctactcctcaacgtaaccgcagaagacctaggcaaaacattctcagtaggcacagggaactgcaccaccaacatactcgaagcaaaatattggtgcccagactcaatggaatacaactgccccaacctcagcccacgcgaagaaccagacgacatcgactgctggtgctacggcgtcgaaaacgtcagagtcgcctacggacgatgtgacgccgtcggacggagcaaaagaagccgccgcgcgatcgacctaccgacacacgagaaccacggactaaaaacacgccaggaaaagtggatgacaggaaggatgggggaacgacagctacagaaaatagaaagatggcttgtacgaaaccccttcttcgcagtaacggcactagcaatagcctaccttgtaggaaacaacacaacacaacgcgtagtcatcgccctcctcgtcctcgccgtcggccccgcctacagtgcccactgcatcggcataaccgaccgcgacttcatcgagggagtacacggcgggacatgggtctcggcaacgctggaacaagacaaatgcgtaaccgtaatggcacctgacaaaccatccctagacataagcctgcaaacagttgccatagacggcccagcagaagcccgcaaagtatgctacagcgctgtactaacacatgtaaaaatcaacgacaaatgccccagcacaggagaagcacacctagccgaagaaaacgacggggacaacgcgtgcaagagaacatatagcgaccgcggttgggggaacggctgcggactcttcggcaaaggatccatagtagcctgcgccaaattcacatgcgcgaaaagcatgagcctcttcgaagtcgaccaaaccaaaatccagtacgtcatacgagcccaactccacgtcggcgcgaaacaggagaactggaacaccgacataaaaacactaaaattcgacgcactatcaggctcccaagaagccgagttcacaggctacggcaaagccaccctagaatgccaagtccaaacggcagtggacttcggaaacagctacatagccgaaatggaaaaagacagctggatcgtcgacagacaatgggcccaagacctaaccctaccgtggcaaagcggcagcgggggcatatggagagaaatgcaccacctcgtggagttcgaaccaccccacgcagccaccatcagagtccttgccctgggcaaccaggaaggaagcctcaaaacagccctaacaggagcaatgagggtgactaaggacgaaaacgacaacaacctctacaaacttcatggaggacacgtcagctgccgggtcaaactcagcgcgctgaccctcaaaggcaccagctacaagatgtgcacagacaagatgtcgttcgtcaaaaacccaaccgacaccggccacgggactgtagtaatgcaagtcaaagtcccaaaaggagcgccctgcaaaatacccgttatagtcgcagacgacctaacagcagctgttaacaaaggaatcctagtaacagtcaacccaatcgcctcgaccaacgacgacgaagtccttatcgaagtcaatccccctttcggagactcctacataatagtagggacaggcgactcccgattaacgtatcaatggcacaaggaaggcagcagcataggcaaactcttcacacaaacaatgaagggggcagaacgcctggccgtaatgggagacgccgcgtgggacttcagctcagccggcggcttcttcacaagcgtaggcaaagggatccacaccgtcttcggatcagcattccaaggcctcttcgggggcctatcatggatcaccaaggtgatcatgggcgccgtcctcatatgggtaggaatcaacacacgaaacatgaccatgtcaatgtccatgatcctggtcggcgtcatcatgatgttcctatcgctcggagtaggcgccgaccaaggatgcgcagtcaacttcggaaaa

SEQ ID NO: 945 - RNA, 2091 nt, synthetic construct
  misc_feature 1..2091: note = derived and/or modified CDS sequence (opt11) from YFV__KX010994__X-SS-prME-XX
  source 1..2091: mol_type = other RNA
atgcgaggactaagctcaagaaaacggcgaagcaacgaaatggccatgttcccattattactactaggactcctggccctcagcggaggagtaacacttgtcaggaagaacaggtggctgctactaaacgtaacagcggaggacctcgggaaaaccttttcagtgggaaccgggaactgcacaacgaacatactagaagcaaagtactggtgccccgacagcatggaatacaactgcccaaacctaagcccaagagaagaacccgatgacatcgactgctggtgctacggagtcgagaacgtacgagtcgcctacggcagatgcgacgcagtaggacgatccaagcggagcagacgcgccatagatctacctacacacgaaaaccacggcctcaaaacacgccaggaaaagtggatgaccggcagaatgggggaacgacaactccagaaaatcgaaagatggctagtaagaaacccgttctttgccgtaaccgcactagcaatagcatacctggtaggaaacaacaccacccaaagagtcgtcatcgcactcttagtactagcagtaggcccagcctatagcgcacactgtatcggcataacggaccgggacttcatcgagggcgtccatggcggaacgtgggtgagcgccacgctagaacaagacaagtgcgtgaccgtgatggcacctgacaaaccgagcctcgacataagcctacaaacagtggccatagacggcccagcagaagcccgaaaagtatgctacagtgcagtcctaacacacgtcaaaatcaacgataaatgcccaagtaccggcgaagcccacctcgccgaagaaaacgatggcgataacgcatgcaagcgaacatactccgacagaggatggggaaacggctgcggactattcgggaaaggatcaatcgtagcatgcgcaaaattcacgtgtgccaaaagcatgtcactctttgaagtagaccagaccaagatacaatacgtcataagagcgcagctacacgtgggcgcgaaacaagaaaattggaacacggacataaaaacgttaaaattcgacgccctctccggatcccaagaagccgagttcacaggctacggcaaagcgaccctagaatgccaggtccaaacagccgtagacttcgggaactcctacatcgccgaaatggaaaaggacagctggatagtcgaccggcaatgggcacaagacctaacactcccctggcagagcggcagcggaggaatctggcgcgaaatgcaccaccttgtcgagttcgaaccgccccacgcagcaacgatacgagtcctagcgctcggcaaccaagaaggaagcctcaaaacagcactcaccggggccatgcgtgtcaccaaagacgaaaacgacaacaacctatacaaacttcacggcggacacgttagctgccgcgtaaaactcagcgccctcaccctcaagggcacgtcatacaaaatgtgcacagacaagatgtcattcgttaagaaccccaccgacacaggccacggcaccgtagtaatgcaagtaaaagtcccaaaaggggccccctgcaagatcccagtaatcgtcgcggacgacctcacggcagcagtaaataagggaatcctggtaaccgtgaacccaatagcaagcaccaacgacgacgaagtgttaatagaggtcaacccacccttcggcgacagctacatcatagtcggcacaggcgactcccgcctaacataccaatggcataaagaaggatcatcaatcggaaaactattcacgcaaacaatgaaaggagccgaacgactcgccgtcatgggcgacgcagcctgggacttcagcagtgccggcggcttcttcaccagcgtagggaaaggcatccacaccgtcttcggatcagcgttccaaggcctcttcggcggactatcctggatcacaaaggtaataatgggggccgtactgatatgggtaggcataaacacaagaaacatgacaatgagcatgtccatgatcctagtcggagtaatcatgatgttcctaagtctaggagtcggggccgaccaaggatgcgccgtaaacttcggaaag

SEQ ID NO: 946 - RNA, 2091 nt, synthetic construct
  misc_feature 1..2091: note = derived and/or modified CDS sequence (opt11) from YFV__KX027336__X-SS-prME-XX
  source 1..2091: mol_type = other RNA
atgagagggctggcatcaagaaagcgacgatccaacgaaatggcaatggtacccctacttttactcggcctcctagcactaagcggaggcgtgaccctagtccgcaaaaatagatggctactcctcaacgtcacagcagaggatctcggcaaaacattcagcgtgggtacaggaaactgcacgacaaacatcctagaagcgaaatactggtgtccagacagcatggaatacaactgccccaacctgtcaccacgggaggaacccgacgacatagactgctggtgctacggagtggagaacgtgcgggtcgcatacggacgatgcgacgccgtgggaaggagcaaacgaagccgcagagccatagacctgcccacacacgagaaccacggactcaaaacgaggcaagaaaaatggatgaccgggcgaatgggcgaacgccaactccaaaagatcgaacggtggctagtcagaaacccattcttcgcagtcaccgcattggcaatagcatacttagtcgggaacaacacgacacaaagagtagtgatagcccttctcgtactagccgtaggcccggcatactcagcacattgcatcggaatcacagacagggacttcatcgaaggcgtacacggaggaacatgggtgagcgcgacgctggaacaggacaaatgcgtaacagtgatggcgccggacaagccgagcctcgacataagcctccagacagtcgcaatagatgggcccgccgaagcaaggaaagtgtgctacagcgcggtcctcacgcacgtaaaaataaacgacaaatgcccctcaacaggagaagcacatctggcagaagaaaacgacggagacaacgcgtgcaaacgcacatactcagacaggggatggggaaacggctgcggcctcttcggtaagggatccatcgtcgcgtgcgcaaaattcacatgcgcaaaaagcatgagcctgttcgaagtcgaccaaacaaaaatccaatacgtcatacgcgcacaactacacgtcggcgcaaaacaagaaaactggaacactgacatcaaaaccctcaaattcgacgcactatccggcagccaagaagccgagttcacaggatacggaaaagcaacactcgaatgccaggtccaaaccgcagtagacttcggcaactcatacatcgccgaaatggaaaaggatagctggatagtggaccgacaatgggcccaggacttaacactcccatggcaaagcggaagcggcggaatatggcgcgagatgcaccacctagtagagttcgaacccccgcacgcggccacaataagggttctagcgctgggaaaccaagaagggtcactaaaaacagcgctcacaggcgccatgagagtcacaaaagacgagaacgataataacctctacaaactacacggcgggcacgtaagctgcagggtaaaactaagcgcacttacactaaagggcacgagctacaaaatgtgtacggacaaaatgagcttcgtgaaaaacccaacggacacaggacacggcacggtcgtcatgcaagtaaaagtcccaaaaggagccccgtgcaagatcccagtcatcgtagccgacgacctaaccgcagcagtaaacaaaggaatcctagtaacagtcaacccgatagcctcaaccaatgacgacgaagtcctaatcgaagtaaacccacccttcggggacagctacatcatagtaggcacaggagatagccgactaacctaccaatggcacaaagagggcagcagcatcggaaagctgttcacgcagacaatgaaaggtgcggaaaggctcgcggtcatgggagacgccgcatgggatttctcaagcgcgggcggcttcttcacctcagtcgggaaaggaatacacaccgtgtttggcagcgccttccaagggttgttcgggggcctatcctggatcacgaaagtaatcatgggcgcggtcctaatctgggtagggatcaacaccagaaacatgacgatgagcatgagcatgatactggtaggagtcataatgatgttcctgagcctgggcgttggagcggaccagggatgcgccgtgaacttcggcaaa

SEQ ID NO: 947 - RNA, 2091 nt, synthetic construct
  misc_feature 1..2091: note = derived and/or modified CDS sequence (opt11) from YFV__JX898868__X-SS-prME-XX
  source 1..2091: mol_type = other RNA
atgcgcgggctgagcagccgaaaacgcagatcccacgacgcactagcagtccaattcctaatcctcggaatgctcctaatggcagggggcgtcaccctggtacgaaagaaccgatggctactactcaacgtcacgagtgaagatctcggcaaaacgttctccgtcggaacaggaaactgcaccaccaacattctcgaagcgaaatactggtgcccagacagcatggaatacaactgccccaacctaagtccaagagaggaacccgacgacatcgactgctggtgctacggagtagaaaacgtaagagtcgcctacggaaaatgcgactccgccggccgcagtcgaagatcgagacgagccatagaccttccaacccacgaaaaccacggactgaaaacacggcaagaaaaatggatgaccgggaggatgggagaacgacaactccagaaaatagaaaggtggctagtcagaaaccctttcttcgcagtaacggccctcaccatagcatatctcgtaggatccaacatgatgcaacgcgtagtcatcgccctactcgtcctggcagtgggacccgcctacagcgcgcactgcataggaataaccgaccgcgacttcatagaaggagtacatggaggaacatgggtaagcgcaacactagagcaagacaaatgcgtaacagtcatggcacccgacaaaccaagcctagacatatcactagaaaccgtcgcgatagacggcccagcagaagcccgcaaagtctgctacaacgcggtactaacccacgtaaaaatcaacgacaaatgcccaagcacaggcgaagcccacctcgcagaagagaacgagggtgacaacgcatgcaaaaggacatactcagacagagggtggggaaacggctgcggactattcggaaaaggctccatagtggcgtgcgcaaaattcacttgcgcgaaaagcatgagcctcttcgaagtcgaccaaacgaaaatacaatatgtaatccgcgcccaactacacgtaggagcaaaacaagaaaactggaacaccgacatcaaaacccttaaattcgacgcgctatcgggatcacaagaagcagagttcaccggatacggaaaagcaacactagagtgccaagtccaaacagctgtcgactttggaaactcatacatcgcagaaatggaaaaggagagctggatcgtcgacagacaatgggcacaagatttgaccctaccctggcaatccggcagcggcggagtatggcgagaaatgcaccacctagtcgagttcgaaccaccacacgcggctaccatcagagtcctagcactgggaaaccaagaaggatcgctcaaaaccgccctcacaggcgcaatgagagtcaccaaagacacaaatgacaataacctatacaaactccacggtggacacgtctcatgccgcgtcaaactctccgcactcacactgaaaggaacatcgtacaagatgtgcaccgacaagatgagtttcgtaaagaaccccactgacacgggccacggtacagtcgtcatgcaggtcaaggtacccaaaggagccccctgcaagatacccgtgatcgtagcagacgacctgacggccgccatcaacaaaggcattctagtgaccgtcaacccgatagcgagcaccaacgacgatgaagttctaatcgaagtaaacccgccattcggcgactcctacatcatcgtaggaacaggagacagtcgactgacctaccagtggcacaaagaaggctcctccatcgggaagctgttcacacaaacaatgaaaggggcagaacgcctcgcagtcatgggcgacgccgcatgggacttctcatccgcagggggcttctttacatccgtcggcaaggggatacacaccgtattcggcagcgcgttccaaggcctattcggaggactaagctggatcaccaaagtgattatgggagcggtcctcatatgggtcggcataaacacaagaaacatgacaatgtccatgtcaatgatcctagtaggagtcatcatgatgttcctcagcctaggagtaggagccgaccaaggatgtgccatcaacttcggcaag

SEQ ID NO: 948 - RNA, 2091 nt, synthetic construct
  misc_feature 1..2091: note = derived and/or modified CDS sequence (opt11) from YFV__JX898869__X-SS-prME-XX
  source 1..2091: mol_type = other RNA
atgcgcgggctatcgtcccgcaaaaggaggtcgcatgacgtcctgacagtacaattcctaatactcggaatgctactcatggcagggggcgtaacattagtccgaaagaaccgatggctcctgctcaatgtcacaagtgaagacctcgggaaaaccttcagcgtgggaacgggcaactgcacaaccaacatactagaagcgaaatactggtgcccagattccatggaatacaactgtcccaacctctcaccaagagaagaacccgatgacatagactgctggtgctacggagtggaaaacgtaagagtagcatacggcaaatgcgatagcgcaggacggagcagacgctcaagacgagccatagacctacccacgcacgaaaaccacggactaaaaacgagacaagagaaatggatgacaggaaggatgggagaacgccaactccagaaaatagaacgatggctcgtcagaaacccattcttcgcagtgaccgcactcacaatcgcatacctggttgggagcaacatgacacaacgagtcgtgatcgccttactggtcctagccgtcggccccgcatacagcgcgcactgcatcggaataacagacagagacttcatcgaaggcgtgcacggaggaacctgggtgagcgcaacgctggaacaagacaagtgcgtaacagtcatggcaccagacaaaccatccctcgacatctcgctcgaaacggtcgcgatcgacgggccagccgaggccaggaaagtatgctacaacgcagtcctgacccacgtaaaaatcaacgacaaatgcccaagcacaggagaagcccacctagcggaagaaaacgaaggcgacaacgcctgcaaaagaacatactccgaccggggatggggcaacggatgcgggcttttcggcaaaggatccattgtcgcatgcgccaaatttacctgcgcaaaaagcatgagcttgttcgaggtggaccaaacaaagatccaatatgtgatccgggcacaactacacgtgggcgcgaaacaagagaactggaacaccgacatcaaaacactaaaattcgacgcgctctcgggatcacaagaagcagagttcaccggctacggcaaagccacgctagaatgccaagtccaaaccgccgtagacttcggcaactcgtacattgctgaaatggagaaagaaagttggatcgtagacagacagtgggcacaagacctaacactgccatggcaatccgggtcgggcggggtctggagagaaatgcaccacctagtagagttcgaacccccacacgccgccacgatccgggtcctggccttgggcaaccaagaaggctcactcaagaccgcactcacgggagcaatgagagtaacgaaagacaccaacgataataacctatacaaactacacggcgggcacgtatcttgccgcgtgaagctaagcgcgctaacgctgaaaggcacgtcctacaaaatgtgcacggacaaaatgagcttcgtcaaaaatcccacggacacgggccacggtacagtagtcatgcaagtcaaggtcccaaaaggagccccatgcaaaatacccgtcatcgtcgcagacgacctcacagccgcggtcaacaaagggatcctagtaacggtcaacccgatagcctcgaccaacgacgacgaagtactgatagaagtgaacccgccattcggagacagctacataatagtaggaacaggagactcacgactaacataccaatggcacaaagaagggagctcgataggcaaattattcacacaaaccatgaagggtgcagaacgacttgcggtgatgggagacgcggcgtgggacttctcgagcgcaggcggattcttcacatcaatcggcaaaggaatccacaccgtctttggcagcgcattccaaggcttgttcgggggactgagctggatcacaaaagtcataatgggagcagtgctaatctgggtcggaataaacacaaggaacatgacaatgagcatgagcatgatcctggtaggggtaataatgatgttcctaagcctgggcgtaggagccgaccaaggatgcgctataaacttcggaaaa

SEQ ID NO: 949 - RNA, 2091 nt, synthetic construct
  misc_feature 1..2091: note = derived and/or modified CDS sequence (opt11) from YFV__JX898873__X-SS-prME-XX
  source 1..2091: mol_type = other RNA
atgagagggctgtcaagcagaaaacgccggagccacgacgcactgaccgtccaattactgatcctaggaatgatactcatggcaggcggagtcaccctcgtccgcaaaaaccgatggttactactcaacgtaacgagcgaagaccttggaaaaaccttcagcgtcggaaccggaaactgcactaccaacatcctcgaagcaaaatactggtgccccgacagcatggaatacaactgcccaaacctaagcccccgcgaagaaccggacgacatagactgctggtgctacggcgtagaaaacgtccgcgtggcctacggtaagtgcgactcagcaggccgttcaagaagaagcagacgagccatagacctccccactcacgaaaaccacggactcaaaacacgacaagaaaaatggatgacaggaagaatgggcgaaagacagctccagaaaatagagcgctggctagtcagaaaccccttcttcgccgtcacagcactcacaatcgcatacctcgtaggaagcaacatgacacaaagagtcgtaatcgccctcctagtactagcagtagggcccgcctactcagcacactgcataggtataacggaccgcgacttcatcgaaggggttcacgggggcacgtgggtaagcgcgaccctcgaacaagacaaatgcgtcaccgtaatggcaccagacaaacccagcctcgacatatcactcgaaacagtcgccatagacggcccggcggaagcccgaaaagtatgttacaacgctgtcctaacccacgtcaaaatcaacgataagtgtccttccacaggcgaagcccaccttgcagaagagaacgaaggagacaacgcatgcaaacgcacctactccgaccgcggatggggaaacggatgcggcctattcggtaaaggcagtatagtcgcatgcgcaaaatttacctgcgccaagagcatgagcctcttcgaagtagaccaaacaaagatacagtacgtaatacgcgcacagctacacgtgggagccaaacaagaaaactggaacacggatataaagaccttaaaattcgacgctctctcgggatcgcaagaagcggagttcaccggctacggcaaggccacgctcgaatgccaagtacaaacagcggtagacttcggaaacagctacatagccgaaatggaaaaagaaagctggatagtagaccgccaatgggcacaagacctaaccctaccctggcagagcggctcaggcggggtgtggagagaaatgcaccacctcgtagagttcgaaccaccgcacgcagcgacaatccgagtactcgcactcggaaaccaagaaggcagcctcaaaaccgccctaaccggagctacaagagtcaccaaagacacaaacgacaataacctctacaaactccacggaggacacgtaagctgtagagtgaaactatccgcgctaacactcaaaggaaccagctacaaaatgtgcacggacaagatgtccttcgtgaaaaatccaacggacacggggcacggaacagtagtcatgcaagtgaaagtgcccaaaggcgcaccatgcaaaatcccagtcatagtagcagatgacctaaccgcagcgataaacaaaggcatactcgtaacggtcaaccccatagcaagcacaaacgacgacgaagtactcatagaagtgaacccacccttcggcgacagttacatcatagtcggcacaggagattccaggctcacataccagtggcacaaggaagggtcctcaataggaaaactattcacccaaacaatgaaaggagcagaacggctcgcagtcatgggagacgccgcatgggatttcagcagcgccggcggcttcttcacctcagtagggaaaggaatacacaccgtgttcggatcggccttccagggactattcggcggactatcatggataacaaaagtaatcatgggggcagtactaatctgggtaggcattaacaccagaaacatgacaatgtccatgagcatgatcctcgtaggagtcatcatgatgttcctaagtctaggcgtgggtgcagaccaaggatgcgccatcaacttcggcaaa

SEQ ID NO: 950 - RNA, 2091 nt, synthetic construct
  misc_feature 1..2091: note = derived and/or modified CDS sequence (opt11) from YFV__JX898874__X-SS-prME-XX
  source 1..2091: mol_type = other RNA
atgcgcggcctcagctccaggaagcgacgatcacacgacgcactaaccgtccaactcctaatactaggaatgatattgatggccggaggcgtgaccctagtacgaaagaaccgatggctactgctgaacgtaaccagcgaagacctgggaaaaacgttcagcgtcggcacagggaactgcacaacaaacatactcgaagcaaaatactggtgccccgactccatggagtacaactgcccaaacctgagcccaagagaagaacccgacgacatagactgctggtgctacggcgtcgaaaacgtgagggtagcgtacggcaaatgcgacagtgccggcagaagccgacgcagccgacgtgcaatagacttacccacgcacgaaaaccacggcctaaaaacgcgccaagaaaaatggatgaccgggcgaatgggcgaaaggcagctccagaaaatagaacgatggctggtaagaaaccccttctttgcggtaaccgccctcacaatagcgtaccttgtcggctcgaacatgacgcagcgggtcgtaatagcactcctggtactcgccgtcggacccgcctacagcgcacactgcataggaatcacagaccgagacttcatagagggggtccacggaggaacatgggtatcggccaccctggagcaagacaaatgcgtaaccgtaatggcacccgacaagccgagcctagacataagcctagaaacagttgccatcgacggacccgccgaagccaggaaagtctgctacaacgccgtactaacgcacgtcaaaataaatgacaagtgccccagcacgggtgaagcgcacctcgcagaagaaaacgaaggagacaacgcgtgcaaacggacgtacagcgacagaggctggggcaacgggtgcggcctattcggcaaaggttcaatagtagcgtgcgcaaaatttacctgcgcaaagagcatgagccttttcgaagtcgaccagacaaagatccaatacgtcatacgcgcccaactgcacgttggagcaaaacaggaaaactggaacacagacatcaaaaccctcaaattcgacgcactatcgggctcgcaagaagccgagttcacgggatatggcaaagccaccctcgaatgccaagtccaaacagcggtcgacttcggaaatagttacatagcagaaatggaaaaggaaagctggatcgtcgacagacaatgggcacaagacctaaccctgccatggcaaagcggcagcggaggggtctggcgtgaaatgcaccacctggtcgagttcgaaccgcctcacgcggccaccataagagtcctagccctcggaaaccaagaaggctcactcaaaacagcgctaacaggagcgatgagggtaaccaaagacacgaacgacaacaacttatacaaactacacggcggccacgtcagctgccgagtgaaactctcagcgctaacactcaagggcaccagctacaaaatgtgcacggacaaaatgtcattcgtgaaaaatccgacagacaccggccatggaaccgtagtcatgcaagtgaaggtcccaaaaggagccccatgcaagatccccgtaatagtcgcagacgacctcacagcggccatcaataaaggcatcctcgtcacggtaaacccaatcgcgagcactaacgacgacgaagtactaatagaagtaaacccacccttcggcgacagctacataatagtgggcaccggagactcaagactcacctaccagtggcacaaagaaggatctagcataggaaagctattcacgcaaacaatgaagggcgccgaacgcctagccgtaatgggcgacgctgcatgggacttctcaagcgcgggaggtttcttcaccagcgtcggcaaaggcatccacacagtgttcggcagcgcattccaaggcctcttcggcggactaagctggatcaccaaagtgatcatgggtgcggtcctgatatgggtcggaataaacaccagaaacatgacaatgagcatgtcaatgatactggtcggagtaatcatgatgttcctcagcctcggcgtaggagccgaccaaggatgtgcaataaacttcggcaag

SEQ ID NO: 951 - RNA, 2091 nt, synthetic construct
  misc_feature 1..2091: note = derived and/or modified CDS sequence (opt11) from YFV__JX898875__X-SS-prME-XX
  source 1..2091: mol_type = other RNA
atgagagggctaagcagcaggaaaagaagaagccacgatgcgctgacagtgcaactattaatactcggaatgatcctaatggcaggaggcgtaacgctcgtacgaaagaacagatggctgctgctcaacgtcacaagcgaagacctgggaaaaacgttcagcgtgggaacaggaaactgcacgacaaacatattggaagcaaaatactggtgccccgacagtatggagtataactgcccaaacctatcaccgagagaagaacccgacgacatagattgctggtgttacggggtcgagaacgtaagagtggcctacggaaaatgtgacagcgcgggcaggagcaggaggtccagaagggccatagacctaccaactcacgagaaccacgggctaaaaacaaggcaagaaaagtggatgacaggacgaatgggagagcgacaactacagaaaatagagagatggctggtcagaaacccgttcttcgcagtaacggctctaaccatagcatacctcgtcgggagcaacatgacgcagagagtggtgatagcactgctcgtattagcagtaggaccggcatactcggcacactgcatagggataacagacagagacttcatcgaaggagtccacgggggaacgtgggtgagcgcaacactggagcaggacaaatgcgtgacagtaatggcacccgacaaacccagcctagacataagcctcgaaacagtagcaatagacggcccggcggaggccaggaaagtgtgctacaatgccgtactaacacacgtcaaaatcaacgacaaatgccccagcacaggagaggcgcacctggcagaagaaaacgagggcgacaacgcatgcaaaaggacatacagcgaccgcggatggggaaacggctgcggcctgttcgggaagggaagcatagtcgcatgcgcaaaatttacgtgcgcaaaaagcatgtcactattcgaagtagaccaaacaaaaatccagtacgtcattcgcgcacagctacacgtaggggcaaaacaggaaaactggaatacagacataaaaaccctgaaattcgacgcgctaagcggaagtcaggaagcgaaattcacgggatacggcaaggccacgctagagtgtcaagtgcaaacagccgtcgattttggaaactcctacatcgcggaaatggaaaaagaatcgtggatagtagacaggcaatgggcgcaagacctgacactaccgtggcaaagcggctcaggcggagtgtggagagaaatgcaccacctggtagagttcgagccaccccacgcggccacaatcagagtactagcactgggaaaccaagagggatcactgaaaaccgcgctgacaggagcaatgcgcgtcaccaaagataccaacgacaacaacctatacaaattacacggcgggcatgtgagctgcagagtaaaactgagcgcactaacgctaaaagggacgagctataaaatgtgcacagacaagatgagcttcgtgaaaaacccaacagacaccggccacggaacagtcgtaatgcaggtcaaagtgccgaagggggcgccatgcaaaatacccgtgatagtggccgatgacctaacagcagcaataaacaaagggatactcgtaacagtaaacccaatagcatccacgaacgatgatgaggtactaatcgaggtgaacccgccctttggcgacagctacataatcgtaggaacaggagacagcaggctgacctaccaatggcacaaagaaggaagctcgatcggaaaactgttcacacaaacaatgaagggcgcggagcgactagcggtcatgggagacgcagcgtgggacttcagcagcgcaggaggattcttcacgtcagtcgggaaaggaatacatacggtattcggaagcgcattccaagggctattcggcggcctgagctggatcacgaaagtgatcatgggagcggtcctcatatgggtaggcatcaacacccggaacatgaccatgagcatgagtatgatcctagtaggagtcataatgatgttcctaagcctcggagtaggagcagaccaaggatgcgcgataaactttggcaaa

SEQ ID NO: 952 - RNA, 2091 nt, synthetic construct
  misc_feature 1..2091: note = derived and/or modified CDS sequence (opt11) from YFV__JX949181__X-SS-prME-XX
  source 1..2091: mol_type = other RNA
atgcgaggactctcgagccgaaaaagacgctcacacgacgtcctaacagtccaattcctaatactcgggatgctgctaatgacaggaggagtaacgctcgtcagaaagaatcgctggttactactaaacgtgacgtcagaagacctaggcaaaaccttcagcgttggcacaggcaactgcaccaccaatatcctcgaggcaaaatactggtgccctgactccatggaatacaactgtcccaacctctcaccacgcgaagaaccggacgacatagactgctggtgctacggagtcgaaaacgtcagagtggcctacggaaaatgcgacagcgcaggaaggtcacgaaggtcacgccgagcgatagatctgccaacacacgaaaaccacggcctaaaaacacgacaggaaaagtggatgacaggccggatgggcgaacgccaactccagaaaatcgaacgatggttcgtaaggaaccccttcttcgcagtaaccgcactaacgatcgcgtacctcgtaggaagcaacatgacacaaagggtcgtaatcgccctactcgtcctagccgtcgggccagcctacagcgcacactgcataggcatcacggacagggacttcatagaaggcgtgcacggcggaacgtgggtgagcgcgaccctagaacaagacaaatgcgtcaccgtaatggcgccagacaaaccaagcctcgacataagcctagagaccgtcgcgatagaccgaccagcagaagtcagaaaagtgtgctataacgcagtcctaacccacgtaaaaataaacgacaagtgccccagcacgggcgaagcacacctcgcggaagaaaacgaaggcgacaacgcatgcaaacgcacgtactccgaccgaggctggggtaacggctgcggactgttcggaaaaggttccatagtcgcatgcgccaagtttacctgcgcaaaaagcatgtcactgttcgaagtagaccaaacaaaaatacaatatgtaatacgcgcgcaactgcacgtaggcgcaaaacaagaaaactggacaaccgacatcaaaaccctgaaattcgatgcgctctcgggctcgcaagaagtcgagttcataggatacggaaaagccacactggaatgccaggtacaaacagcagtcgacttcggcaacagttacatcgcagaaatggaaacagaaagctggatcgtggacagacaatgggcccaagacttaacgctgccatggcaaagcggctccggaggggtctggagagaaatgcaccacctggtcgagttcgaacctccacacgcagcaaccatcagagtactggccctaggcaaccaagaaggctcgctgaaaaccgccctcaccggcgcaatgagagtaacaaaggacacaaatgacaacaatctgtacaagctccacggcggacacgtatcatgccgagtcaaattaagcgcgctcacactaaaaggaacgagttacaaaatatgcacagacaagatgttcttcgtgaaaaatcccacagacacgggccatgggaccgtagtcatgcaggtaaaagtatcaaagggggccccatgcagaatcccggtaatcgtcgcggacgacctcactgcagcgatcaacaaaggaatcctagtaaccgtcaatcccatagcatccacaaacgacgacgaagtattgatagaagtaaacccacccttcggcgactcctatataatagtaggacgaggggatagccgattaacctaccaatggcacaaggaggggagcagcataggcaagctattcacacagacaatgaaaggagtggaacgactggcagtcatgggcgacacagcatgggacttctcaagcgcaggaggcttcttcacatccgtcgggaaaggcatccacaccgtcttcggatcggccttccaaggcctgttcgggggcctcaactggataacgaaggtaatcatgggagtggtcctgatctgggtaggcataaatacccgaaatatgacaatgtcaatgagcatgatcctggtaggcgtaataatgatgttcttgagcctaggcgtgggcgcagaccaaggctgtgccataaacttcggaaag

SEQ ID NO: 953 - RNA, 2091 nt, synthetic construct
  misc_feature 1..2091: note = derived and/or modified CDS sequence (opt11) from YFV__AY968064__X-SS-prME-XX
  source 1..2091: mol_type = other RNA
atgcgaggactatcgagcaggaaaaggcgctcaaacgaaatggcgctattccccctactactactagggctactcgccctaagcggaggcgtcaccctggtccggaaaaaccgatggctcctactcaacgtcacagcagaagacctaggaaaaacattcagcgtcggcaccggaaactgcacaacaaacatactggaagccaagtactggtgcccggacagcatggaatacaactgccccaacctaagccccagggaagaacccgacgacatagactgctggtgttacggcgtagaaaacgtgcgagtagcctacggcagatgcgacgcggtcggcagaagcaaacgcagccgccgagccatagacctcccaacacacgaaaaccacggcctaaaaaccagacaagaaaaatggatgacagggcggatgggcgagcgacaactacagaaaatagaaagatggctcgtaagaaatccattcttcgccgtaacggccctagctatagcatacctggtcggcaacaacactacgcaaagggttgtcatcgccctcctggtactggccgtgggaccggcatacagcgcacactgcatcggaataacagaccgagactttatcgagggcgtacacggaggaacatgggtcagcgccaccctcgaacaagacaaatgcgtaaccgtcatggccccagacaaaccatcactagacatctcactccaaactgtcgcaatcgacggcccagcggaagcccgaaaagtgtgctacagcgcagtcctaacacacgtgaagataaacgacaagtgcccaagcacaggcgaggcacacctagcagaagagaacgacggcgacaacgcttgcaaacgaacctactccgacagaggatggggcaatggctgcggacttttcggaaaaggaagtatagtcgcctgcgcaaagttcacatgcgcgaagtccatgagcctgttcgaagtcgaccaaacaaaaatacaatacgtaatacgcgcacagctacacgtgggagcaaaacaggaaaactggaacaccgacatcaaaacgctcaaattcgacgcactgagcggctcccaggaagccgagttcacaggatatggcaaagcgacactagaatgccaagtccaaacagcagtagacttcgggaacagctacatcgcagaaatggaaaaggacagctggatcgtcgaccggcaatgggcacaagacttaacactaccatggcaaagcggctccggcggaatatggcgagaaatgcaccatttagtcgagttcgaacccccacacgcagcaacgatcagagtactcgccctaggaaaccaggaaggaagcctaaaaacagcactcaccggcgccatgagagtaacaaaagatgaaaacgataacaacctatacaagctccacggaggacacgtatcatgccgcgtcaaattgtccgcattaacgctcaagggaaccagctacaaaatgtgcacagacaaaatgtcattcgtcaagaacccaaccgacacaggccacggtacagtagtcatgcaagtaaaagtaccaaaaggcgcaccatgcaagatcccggttatagtcgcagacgacctcacggcagcagtcaacaaaggcattctagtaacagtaaaccccatagccagcacaaacgacgacgaagtgctcatcgaagtaaacccgccattcggagactcgtatataatagtaggaacaggcgacagccgactgacctaccaatggcacaaagaaggcagcagcatcggcaaactgttcacccaaaccatgaagggagcggaaagattagcagtaatgggagacgcagcctgggacttcagcagcgcgggaggattcttcacgagcgtcggcaaaggcatccacaccgtcttcggaagcgccttccaaggactgttcggaggactctcctggatcacgaaggtaataatgggcgccgtcctaatatgggtaggaataaacacccgaaacatgaccatgtccatgagcatgatcctagtcggagtcataatgatgttcctaagcctaggcgtgggagctgaccaaggctgcgccgtcaacttcggaaag

SEQ ID NO: 954 - RNA, 2091 nt, synthetic construct
  misc_feature 1..2091: note = derived and/or modified CDS sequence (opt11) from YFV__AY968065__X-SS-prME-XX
  source 1..2091: mol_type = other RNA
atgcgaggcctctcgagcagaaagagacgaagcagcgagatgaccatgatgcccctactcatactatctatggtaatactcgggggcggggtaacactggtaaggaagaaccgctggctcctgctgaacgtaaccgcagaggacctaggaaaaacctttagtgtaggaacaggaaactgtacaaccaacatactagaagccaaatactggtgccctgacagcatggaatataactgccccaacctcagccccagagaagaaccagacgacatagactgttggtgctacggcgtcgagaacgtcagagtggcctacggccgatgcgacgcagtagggcgaagcaagagatcacgccgggccatagacttacccactcacgaaaaccatggcctcaaaacaagacaagaaaaatggatgacaggacgaatgggagagcgccagctccagaaaatagaacgatggctagtacgaaacccattcttcgcagtgacagcactcgcaatagcctacctagtagggaacaacaagacacaaagagtcgtcatcgcactcctagttctcgccgtaggaccagcctactccgcacactgcataggaatcaccgacagagacttcatcgagggagtgcacggaggaacatgggtaagcgcaagcctagaacaagacaaatgcgtaacagtaatggcaccagacaaaccgagccttgacatcagcctccaaacagtcgcaatagacggcccagccgaagcacgcaaggtatgctacagcgcagtcttaacacacgtcaagataaacgataaatgcccaagcactggcgaagcccacctcgcagaagagaacgacggcgacaacgcatgcaaaagaacctactcggaccgcggatggggaaacggctgcggcctcttcggcaaagggtccatagtggcatgcgccaaatttacctgcgcgaaaagcatgagcctcttcgaggtagaccaaaccaagatccaatacgtaatacgagcccaactgcacgtgggcgcaaaacaagaaaactggaacacagatataaagaccctgaaattcgacgccctcagcggctcgcaagaagccgagttcaccggctacggaaaagcaacgctagaatgccaagtccagactgcggtcgacttcggaaactcatacatagccgaaatggagaaggatagttggatagtagaccgacaatgggcccaagacctcacactaccctggcaatccggatccggaggaatatggcgagaaatgcaccacctcgtcgagttcgagcccccacacgccgcaacgataagagtcctcgcactaggcaaccaagaaggctcgctaaaaacagcactgacgggcgccatgcgagtcaccaaagacgaaaacgacaacaacctctacaaactccacggaggacacgtatcctgccgggtgaaactatccgccctgacacttaaaggaacatcatacaaaatgtgcacagacaaaatgagcttcgtcaaaaacccgacagacacgggacacggcacggtagtcatgcaagtaaaagtcccaaaaggagccccgtgcaagatccctgtcatagtcgcggacgacctcacggccgccgtcaacaaaggaatcctagtcacggtaaaccccatagcaagcaccaacgacgacgaagtgctcatagaagtaaacccaccattcggggacagctacataatagtcggcaccggagacagtcgcctaacctatcaatggcataaagaaggatcatcaatcggaaaactgttcacgcaaacaatgaaaggcgtggaaagactcgcagtcatgggagacgccgcgtgggacttctcttcggctggcggattcttcacgtcagtaggcaaaggcatccacaccgtattcggaagcgcattccaaggcctattcggaggactaagctggataacaaaagttataatgggagcggtcctaatctgggtcggcatcaacaccagaaacatgacaatgagtatgagcatgatcctagtcggagtaataatgatgttcctcagtttgggagtcggggcagaccagggatgcgcagtaaacttcggaaag

SEQ ID NO: 955 - protein, 25 aa, synthetic construct
  REGION 1..25: note = derived and/or modified protein sequence (wt) from Homo sapiens__SigSeq(TPA)/SStPA
MDAMKRGLCCVLLLCGAVFVDSVTG

SEQ ID NO: 956 - protein, 163 aa, synthetic construct
  REGION 1..163: note = derived and/or modified protein sequence (wt) from Helicobacter pylori J99__Ferritin
DIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 957 - protein, 150 aa, synthetic construct
  REGION 1..150: note = derived and/or modified protein sequence (wt) from Woodchuck hepatitis virus__WHbcAg
MDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVIC

SEQ ID NO: 958 - protein, 101 aa, synthetic construct
  REGION 1..101: note = derived and/or modified protein sequence (wt) from Japanese encephalitis virus__Cterm-JEV/JEV
GSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 959 - protein, 5 aa, synthetic construct
  REGION 1..5: note = derived and/or modified protein sequence (wt) from Artificial__MKRKK
MKRKK

SEQ ID NO: 960 - skipped

SEQ ID NO: 961 - protein, 9 aa, synthetic construct
  REGION 1..9: note = derived and/or modified protein sequence (wt) from Artificial__Linker(G4SG4)
GGGGSGGGG

SEQ ID NO: 962 - protein, 17 aa, synthetic construct
  REGION 1..17: note = derived and/or modified protein sequence (wt) from Foot-and-mouth disease virus__F2A/P2A
NFDLLKLAGDVESNPGP

SEQ ID NO: 963 - protein, 100 aa, synthetic construct
  REGION 1..100: note = derived and/or modified protein sequence (wt) from DENV-1 CYD23__C
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRRK

SEQ ID NO: 964 - protein, 114 aa, synthetic construct
  REGION 1..114: note = derived and/or modified protein sequence (wt) from DENV-1 CYD23__C-SSc
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRRKSVTMLLMLMPTALA

SEQ ID NO: 965 - protein, 91 aa, synthetic construct
  REGION 1..91: note = derived and/or modified protein sequence (wt) from DENV-1 CYD23__pr
FHLTTRGGEPHMIVSKQERGKSLLFKTSAGVNMCTLIAMDLGELCEDTMTYKCPRITEAEPDDVDCWCNATDTWVTYGTCSQTGEHRRDKR

SEQ ID NO: 966 - protein, 75 aa, synthetic construct
  REGION 1..75: note = derived and/or modified protein sequence (wt) from DENV-1 CYD23__M
SVALAPHVGLGLETRTETWMSSEGAWKQIQRVETWALRHPGFTVIALFLAHAIGTSITQKGIIFILLMLVTPSMA

SEQ ID NO: 967 - protein, 166 aa, synthetic construct
  REGION 1..166: note = derived and/or modified protein sequence (wt) from DENV-1 CYD23__prM
FHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMA

SEQ ID NO: 968 - protein, 495 aa, synthetic construct
  REGION 1..495: note = derived and/or modified protein sequence (wt) from DENV-1 CYD23__E
MRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 969 - protein, 661 aa, synthetic construct
  REGION 1..661: note = derived and/or modified protein sequence (wt) from DENV-1 CYD23__prME
FHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 970 - protein, 675 aa, synthetic construct
  REGION 1..675: note = derived and/or modified protein sequence (wt) from DENV-1 CYD23__SSc-prME
SVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 971 - protein, 775 aa, synthetic construct
  REGION 1..775: note = derived and/or modified protein sequence (wt) from DENV-1 CYD23__C-prME
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRRKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 972 - protein, 15 aa, synthetic construct
  REGION 1..15: note = derived and/or modified protein sequence (wt) from DENV-1 CYD23__SSc
MSVTMLLMLMPTALA

SEQ ID NO: 973 - protein, 19 aa, synthetic construct
  REGION 1..19: note = derived and/or modified protein sequence (wt) from DENV-1 CYD23__SSopt
MKRKKSVTMLLMLMPTALA

SEQ ID NO: 974 - protein, 19 aa, synthetic construct
  REGION 1..19: note = derived and/or modified protein sequence (wt) from DENV-1 CYD23__SSm
MTQKGIIFILLMLVTPSMA

SEQ ID NO: 975 - protein, 495 aa, synthetic construct; identical to SEQ ID NO: 968
  REGION 1..495: note = derived and/or modified protein sequence (wt) from DENV-1 CYD23__E

SEQ ID NO: 976 - protein, 394 aa, synthetic construct
  REGION 1..394: note = derived and/or modified protein sequence (wt) from DENV-1 CYD23__EdelTM-variant (aa1-394)
MRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKK

SEQ ID NO: 977 - protein, 424 aa, synthetic construct
  REGION 1..424: note = derived and/or modified protein sequence (wt) from DENV-1 CYD23__EdelTM-variant (aa1-424)
MRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGS

SEQ ID NO: 978 - protein, 421 aa, synthetic construct
  REGION 1..421: note = derived and/or modified protein sequence (wt) from DENV-1 CYD23__EdelTM-variant (aa1-421)
MRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWD

SEQ ID NO: 979 - protein, 676 aa, synthetic construct
  REGION 1..676: note = derived and/or modified protein sequence (wt) from DENV-1 CYD23__SSc-prME
MSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 980 - protein, 676 aa, synthetic construct
  REGION 1..676: note = derived and/or modified protein sequence (wt) from DENV-1 CYD23__SSc-prME(F108S)
MSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLSGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 981 - protein, 676 aa, synthetic construct
  REGION 1..676: note = derived and/or modified protein sequence (wt) from DENV-1 CYD23__SSc-prMEdelstem_TM-JEV
MSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 982 - protein, 792 aa, synthetic construct
  REGION 1..792: note = derived and/or modified protein sequence (wt) from DENV-1 CYD23__C-P2A-SSc-prME
MNNQRKKTARPSFNMLKRARNRVSTVSQLAKRFSKGLLSGQGPMKLVMAFIAFLRFLAIPPTAGILARWGSFKKNGAIKVLRGFKKEISNMLNIMNRRRKNFDLLKLAGDVESNPGPSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLLTCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 983 - protein, 680 aa, synthetic construct
  REGION 1..680: note = derived and/or modified protein sequence (wt) from DENV-1 CYD23__SSopt-prME(F108S)
MKRKKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLSGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 984 - protein, 680 aa, synthetic construct
  REGION 1..680: note = derived and/or modified protein sequence (wt) from DENV-1 CYD23__SSopt-prME(F96H)
MKRKKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTHVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 985 - protein, 680 aa, synthetic construct
  REGION 1..680: note = derived and/or modified protein sequence (wt) from DENV-1 CYD23__SSopt-prME(S186F)
MKRKKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCFPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 986 - protein, 680 aa, synthetic construct
  REGION 1..680: note = derived and/or modified protein sequence (wt) from DENV-1 CYD23__SSopt-prME(R188L)
MKRKKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPLTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSSIGKMFEATARGARRMAILGDTAWDFGSIGGVFTSVGKLVHQIFGTAYGVLFSGVSWTMKIGIGVLLTWLGLNSRSTSLSMTCIAVGLVTLYLGVMVQA

SEQ ID NO: 987 - protein, 680 aa, synthetic construct
  REGION 1..680: note = derived and/or modified protein sequence (wt) from DENV-1 CYD23__SSopt-pr(D104A)MEdelstem_TM,(F108S)-JEV
MKRKKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRAKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLSGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMHTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 988 - protein, 680 aa, synthetic construct
  REGION 1..680: note = derived and/or modified protein sequence (wt) from DENV-1 CYD23__SSopt-prMEdelstem_TM,(H261N)-JEV
MKRKKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPRTGLDFNEMVLLTMKEKSWLVHKQWFLDLPLPWTSGASTSQETWNRQDLLVTFKTAHAKKQEVVVLGSQEGAMNTALTGATEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 989 - protein, 680 aa, synthetic construct
  REGION 1..680: note = derived and/or modified protein sequence (wt) from DENV-1 CYD23__SSopt-prMEdelstem_TM,(R188L,A267T)-JEV
MKRKKSVTMLLMLMPTALAFHLTTRGGEPHMIVSKQERGKSLLFKTSAGVNMCTLIAMDLGELCEDTMTYKCPRITEAEPDDVDCWCNATDTWVTYGTCSQTGEHRRDKRSVALAPHVGLGLETRTETWMSSEGAWKQIQRVETWALRHPGFTVIALFLAHAIGTSITQKGIIFILLMLVTPSMAMRCVGIGSRDFVEGLSGATWVDVVLEHGSCVTTMAKDKPTLDIELLKTEVTNPAVLRKLCIEAKISNTTTDSRCPTQGEATLVEEQDANFVCRRTFVDRGWGNGCGLFGKGSLITCAKFKCVTKLEGKIVQYENLKYSVIVTVHTGDQHQVGNESTEHGTTATITPQAPTTEIQLTDYGALTLDCSPLTGLDFNEMVLLTMKEKSWLVHKQWFLDLPLPWTSGASTSQETWNRQDLLVTFKTAHAKKQEVVVLGSQEGAMHTALTGTTEIQTSGTTTIFAGHLKCRLKMDKLTLKGMSYVMCTGSFKLEKEVAETQHGTVLVQIKYEGTDAPCKIPFSTQDEKGVTQNGRLITANPIVTDKEKPVNIEAEPPFGESYIVIGAGEKALKLSWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 990 - protein, 100 aa, synthetic construct
  REGION 1..100: note = derived and/or modified protein sequence (wt) from DENV-2 CYD2-T__C
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRR

SEQ ID NO: 991 - protein, 114 aa, synthetic construct
  REGION 1..114: note = derived and/or modified protein sequence (wt) from DENV-2 CYD2-T__C-SSc
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMA

SEQ ID NO: 992 - protein, 91 aa, synthetic construct
  REGION 1..91: note = derived and/or modified protein sequence (wt) from DENV-2 CYD2-T__pr
FHLTTRNGEPHMIVSRQEKGKSLLFKTEDGVNMCTLMAMDLGELCEDTITYKCPLLRQNEPEDIDCWCNSTSTWVTYGTCTTMGEHRREKR

SEQ ID NO: 993 - protein, 75 aa, synthetic construct
  REGION 1..75: note = derived and/or modified protein sequence (wt) from DENV-2 CYD2-T__M
SVALVPHVGMGLETRTETWMSSEGAWKHVQRIETWILRHPGFTMMAAILAYTIGTTHFQRALIFILLTAVTPSMT

SEQ ID NO: 994 - protein, 166 aa, synthetic construct
  REGION 1..166: note = derived and/or modified protein sequence (wt) from DENV-2 CYD2-T__prM
FHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMT

SEQ ID NO: 995 - protein, 495 aa, synthetic construct
  REGION 1..495: note = derived and/or modified protein sequence (wt) from DENV-2 CYD2-T__E
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 996 - protein, 661 aa, synthetic construct
  REGION 1..661: note = derived and/or modified protein sequence (wt) from DENV-2 CYD2-T__prME
FHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 997 - protein, 675 aa, synthetic construct
  REGION 1..675: note = derived and/or modified protein sequence (wt) from DENV-2 CYD2-T__SSc-prME
SAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 998 - protein, 775 aa, synthetic construct
  REGION 1..775: note = derived and/or modified protein sequence (wt) from DENV-2 CYD2-T__C-prME
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 999 - protein, 15 aa, synthetic construct
  REGION 1..15: note = derived and/or modified protein sequence (wt) from DENV-2 CYD2-T__SSc
MSAGMIIMLIPTVMA

SEQ ID NO: 1000 - protein, 19 aa, synthetic construct
  REGION 1..19: note = derived and/or modified protein sequence (wt) from DENV-2 CYD2-T__SSopt
MKRKKSAGMIIMLIPTVMA

SEQ ID NO: 1001 - protein, 19 aa, synthetic construct
  REGION 1..19: note = derived and/or modified protein sequence (wt) from DENV-2 CYD2-T__SSm
MFQRALIFILLTAVTPSMT

SEQ ID NO: 1002 - protein, 495 aa, synthetic construct; identical to SEQ ID NO: 995
  REGION 1..495: note = derived and/or modified protein sequence (wt) from DENV-2 CYD2-T__E

SEQ ID NO: 1003 - protein, 394 aa, synthetic construct
  REGION 1..394: note = derived and/or modified protein sequence (wt) from DENV-2 CYD2-T__EdelTM-variant (aa1-394)
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKK

SEQ ID NO: 1004 - protein, 424 aa, synthetic construct
  REGION 1..424: note = derived and/or modified protein sequence (wt) from DENV-2 CYD2-T__EdelTM-variant (aa1-424)
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGS

SEQ ID NO: 1005 - protein, 421 aa, synthetic construct
  REGION 1..421: note = derived and/or modified protein sequence (wt) from DENV-2 CYD2-T__EdelTM-variant (aa1-421)
MRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWD

SEQ ID NO: 1006 - protein, 676 aa, synthetic construct
  REGION 1..676: note = derived and/or modified protein sequence (wt) from DENV-2 CYD2-T__SSc-prME
MSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 1007 - protein, 676 aa, synthetic construct
  REGION 1..676: note = derived and/or modified protein sequence (wt) from DENV-2 CYD2-T__SSc-prME(F108S)
MSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLSGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 1008 - protein, 676 aa, synthetic construct
  REGION 1..676: note = derived and/or modified protein sequence (wt) from DENV-2 CYD2-T__SSc-prMEdelstem_TM-JEV
MSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1009 - protein, 443 aa, synthetic construct
  REGION 1..443: note = derived and/or modified protein sequence (wt) from DENV-2 CYD2-T__SSm-EdelTM
MFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGS

SEQ ID NO: 1010 - protein, 792 aa, synthetic construct
  REGION 1..792: note = derived and/or modified protein sequence (wt) from DENV-2 CYD2-T__C-P2A-SSc-prME
MNNQRKKAKNTPFNMLKRERNRVSTVQQLTKRFSLGMLQGRGPLKLFMALVAFLRFLTIPPTAGILKRWGTIKKSKAINVLRGFRKEIGRMLNILNRRRRNFDLLKLAGDVESNPGPSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 1011 - protein, 680 aa, synthetic construct
  REGION 1..680: note = derived and/or modified protein sequence (wt) from DENV-2 CYD2-T__SSopt-prME(F108S)
MKRKKSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLSGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 1012 - protein, 680 aa, synthetic construct
  REGION 1..680: note = derived and/or modified protein sequence (wt) from DENV-2 CYD2-T__SSopt-prME(M96H)
MKRKKSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSHVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 1013 - protein, 680 aa, synthetic construct
  REGION 1..680: note = derived and/or modified protein sequence (wt) from DENV-2 CYD2-T__SSopt-prME(S186F)
MKRKKSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECFPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 1014 - protein, 680 aa, synthetic construct
  REGION 1..680: note = derived and/or modified protein sequence (wt) from DENV-2 CYD2-T__SSopt-prME(R188L)
MKRKKSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPLTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSSIGQMFETTMRGAKRMAILGDTAWDFGSLGGVFTSIGKALHQVFGAIYGAAFSGVSWTMKILIGVIITWIGMNSRSTSLSVTLVLVGIVTLYLGVMVQA

SEQ ID NO: 1015 - protein, 680 aa, synthetic construct
  REGION 1..680: note = derived and/or modified protein sequence (wt) from DENV-2 CYD2-T__SSopt-pr(D104A)MEdelstem_TM,(F108S)-JEV
MKRKKSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRRAKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLSGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMHTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1016 - protein, 680 aa, synthetic construct
  REGION 1..680: note = derived and/or modified protein sequence (wt) from DENV-2 CYD2-T__SSopt-prMEdelstem_TM,(H261N)-JEV
MKRKKSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPRTGLDFNEMVLLQMENKAWLVHRQWFLDLPLPWLPGADTQGSNWIQKETLVTFKNPHAKKQDVVVLGSQEGAMNTALTGATEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1017 - protein, 680 aa, synthetic construct
  REGION 1..680: note = derived and/or modified protein sequence (wt) from DENV-2 CYD2-T__SSopt-prMEdelstem_TM,(R188L,A267T)-JEV
MKRKKSAGMIIMLIPTVMAFHLTTRNGEPHMIVSRQEKGKSLLFKTEDGVNMCTLMAMDLGELCEDTITYKCPLLRQNEPEDIDCWCNSTSTWVTYGTCTTMGEHRREKRSVALVPHVGMGLETRTETWMSSEGAWKHVQRIETWILRHPGFTMMAAILAYTIGTTHFQRALIFILLTAVTPSMTMRCIGMSNRDFVEGVSGGSWVDIVLEHGSCVTTMAKNKPTLDFELIKTEAKQPATLRKYCIEAKLTNTTTESRCPTQGEPSLNEEQDKRFVCKHSMVDRGWGNGCGLFGKGGIVTCAMFRCKKNMEGKVVQPENLEYTIVITPHSGEEHAVGNDTGKHGKEIKITPQSSITEAELTGYGTVTMECSPLTGLDFNEMVLLQMENKAWLVHRQWFLDLPLPWLPGADTQGSNWIQKETLVTFKNPHAKKQDVVVLGSQEGAMHTALTGTTEIQMSSGNLLFTGHLKCRLRMDKLQLKGMSYSMCTGKFKVVKEIAETQHGTIVIRVQYEGDGSPCKIPFEIMDLEKRHVLGRLITVNPIVTEKDSPVNIEAEPPFGDSYIIIGVEPGQLKLNWFKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1018 - protein, 99 aa, synthetic construct
  REGION 1..99: note = derived and/or modified protein sequence (wt) from DENV-4 Consensus__C
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKR

SEQ ID NO: 1019 - protein, 113 aa, synthetic construct
  REGION 1..113: note = derived and/or modified protein sequence (wt) from DENV-4 Consensus__C-SSc
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMA

SEQ ID NO: 1020 - protein, 91 aa, synthetic construct
  REGION 1..91: note = derived and/or modified protein sequence (wt) from DENV-4 Consensus__pr
FHLSTRDGEPLMIVAKHERGRPLLFKTTEGINKCTLIAMDLGEMCEDTVTYKCPLLVNTEPEDIDCWCNLTSTWVMYGTCTQSGERRREKR

SEQ ID NO: 1021 - protein, 75 aa, synthetic construct
  REGION 1..75: note = derived and/or modified protein sequence (wt) from DENV-4 Consensus__M
SVALTPHSGMGLETRAETWMSSEGAWKHAQRVESWILRNPGFALLAGFMAYMIGQTGIQRTVFFVLMMLVAPSYG

SEQ ID NO: 1022 - protein, 166 aa, synthetic construct
  REGION 1..166: note = derived and/or modified protein sequence (wt) from DENV-4 Consensus__prM
FHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYG

SEQ ID NO: 1023 - protein, 495 aa, synthetic construct
  REGION 1..495: note = derived and/or modified protein sequence (wt) from DENV-4 Consensus__E
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1024 - protein, 661 aa, synthetic construct
  REGION 1..661: note = derived and/or modified protein sequence (wt) from DENV-4 Consensus__prME
FHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1025 - protein, 675 aa, synthetic construct
  REGION 1..675: note = derived and/or modified protein sequence (wt) from DENV-4 Consensus__SSc-prME
STITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1026 - protein, 774 aa, synthetic construct
  REGION 1..774: note = derived and/or modified protein sequence (wt) from DENV-4 Consensus__C-prME
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1027 - protein, 15 aa, synthetic construct
  REGION 1..15: note = derived and/or modified protein sequence (wt) from DENV-4 Consensus__SSc
MSTITLLCLIPTVMA

SEQ ID NO: 1028 - protein, 19 aa, synthetic construct
  REGION 1..19: note = derived and/or modified protein sequence (wt) from DENV-4 Consensus__SSopt
MKRKKSTITLLCLIPTVMA

SEQ ID NO: 1029 - protein, 19 aa, synthetic construct
  REGION 1..19: note = derived and/or modified protein sequence (wt) from DENV-4 Consensus__SSm
MIQRTVFFVLMMLVAPSYG

SEQ ID NO: 1030 - protein, 495 aa, synthetic construct; identical to SEQ ID NO: 1023
  REGION 1..495: note = derived and/or modified protein sequence (wt) from DENV-4 Consensus__E

SEQ ID NO: 1031 - protein, 394 aa, synthetic construct
  REGION 1..394: note = derived and/or modified protein sequence (wt) from DENV-4 Consensus__EdelTM-variant (aa1-394)
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRK

SEQ ID NO: 1032 - protein, 424 aa, synthetic construct
  REGION 1..424: note = derived and/or modified protein sequence (wt) from DENV-4 Consensus__EdelTM-variant (aa1-424)
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGS

SEQ ID NO: 1033 - protein, 421 aa, synthetic construct
  REGION 1..421: note = derived and/or modified protein sequence (wt) from DENV-4 Consensus__EdelTM-variant (aa1-421)
MRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWD

SEQ ID NO: 1034 - protein, 676 aa, synthetic construct
  REGION 1..676: note = derived and/or modified protein sequence (wt) from DENV-4 Consensus__SSc-prME
MSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1035 - protein, 676 aa, synthetic construct
  REGION 1..676: note = derived and/or modified protein sequence (wt) from DENV-4 Consensus__SSc-prME(F108S)
MSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLSGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1036 - protein, 676 aa, synthetic construct
  REGION 1..676: note = derived and/or modified protein sequence (wt) from DENV-4 Consensus__SSc-prMEdelstem_TM-JEV
MSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1037 - protein, 443 aa, synthetic construct
  REGION 1..443: note = derived and/or modified protein sequence (wt) from DENV-4 Consensus__SSm-EdelTM
MIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGS

SEQ ID NO: 1038 - protein, 791 aa, synthetic construct
  REGION 1..791: note = derived and/or modified protein sequence (wt) from DENV-4 Consensus__C-P2A-SSc-prME
MNQRKKVVRPPFNMLKRERNRVSTPQGLVKRFSTGLFSGKGPLRMVLAFITFLRVLSIPPTAGILKRWGQLKKNKAIKILIGFRKEIGRMLNILNGRKRNFDLLKLAGDVESNPGPSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1039 - protein, 680 aa, synthetic construct
  REGION 1..680: note = derived and/or modified protein sequence (wt) from DENV-4 Consensus__SSopt-prME(F108S)
MKRKKSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLSGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1040 - protein, 680 aa, synthetic construct
  REGION 1..680: note = derived and/or modified protein sequence (wt) from DENV-4 Consensus__SSopt-prME(V96H)
MKRKKSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDHVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1041 - protein, 680 aa, synthetic construct
  REGION 1..680: note = derived and/or modified protein sequence (wt) from DENV-4 Consensus__SSopt-prME(E186F)
MKRKKSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCFPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1042 - protein, 680 aa, synthetic construct
  REGION 1..680: note = derived and/or modified protein sequence (wt) from DENV-4 Consensus__SSopt-prME(R188L)
MKRKKSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPLSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSSIGKMFESTYRGAKRMAILGETAWDFGSVGGLFTSLGKAVHQVFGSVYTTMFGGVSWMIRILIGFLVLWIGTNSRNTSMAMTCIAVGGITLFLGFTVQA

SEQ ID NO: 1043 - protein, 680 aa, synthetic construct
  REGION 1..680: note = derived and/or modified protein sequence (wt) from DENV-4 Consensus__SSopt-pr(D104A)MEdelstem_TM,(F108S)-JEV
MKRKKSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRRAKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLSGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMHSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1044 - protein, 680 aa, synthetic construct
  REGION 1..680: note = derived and/or modified protein sequence (wt) from DENV-4 Consensus__SSopt-prMEdelstem_TM,(H261N)-JEV
MKRKKSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPRSGIDFNEMILMKMKKKTWLVHKQWFLDLPLPWTAGADTSEVHWNYKERMVTFKVPHAKRQDVTVLGSQEGAMNSALAGATEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1045 - protein, 680 aa, synthetic construct
  REGION 1..680: note = derived and/or modified protein sequence (wt) from DENV-4 Consensus__SSopt-prMEdelstem_TM,(R188L,A267T)-JEV
MKRKKSTITLLCLIPTVMAFHLSTRDGEPLMIVAKHERGRPLLFKTTEGINKCTLIAMDLGEMCEDTVTYKCPLLVNTEPEDIDCWCNLTSTWVMYGTCTQSGERRREKRSVALTPHSGMGLETRAETWMSSEGAWKHAQRVESWILRNPGFALLAGFMAYMIGQTGIQRTVFFVLMMLVAPSYGMRCVGVGNRDFVEGVSGGAWVDLVLEHGGCVTTMAQGKPTLDFELTKTTAKEVALLRTYCIEASISNITTATRCPTQGEPYLKEEQDQQYICRRDVVDRGWGNGCGLFGKGGVVTCAKFSCSGKITGNLVQIENLEYTVVVTVHNGDTHAVGNDTSNHGVTATITPRSPSVEVKLPDYGELTLDCEPLSGIDFNEMILMKMKKKTWLVHKQWFLDLPLPWTAGADTSEVHWNYKERMVTFKVPHAKRQDVTVLGSQEGAMHSALAGTTEVDSGDGNHMFAGHLKCKVRMEKLRIKGMSYTMCSGKFSIDKEMAETQHGTTVVKVKYEGAGAPCKVPIEIRDVNKEKVVGRVISSTPLAENTNSVTNIELEPPFGDSYIVIGVGNSALTLHWFRKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1046 - protein, 100 aa, synthetic construct
  REGION 1..100: note = derived and/or modified protein sequence (wt) from DENV-3 Consensus__C
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKK

SEQ ID NO: 1047 - protein, 114 aa, synthetic construct
  REGION 1..114: note = derived and/or modified protein sequence (wt) from DENV-3 Consensus__C-SSc
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKTSLCLMMILPAALA

SEQ ID NO: 1048 - protein, 91 aa, synthetic construct
  REGION 1..91: note = derived and/or modified protein sequence (wt) from DENV-3 Consensus__pr
FHLTSRDGEPRMIVGKNERGKSLLFKTASGINMCTLIAMDLGEMCDDTVTYKCPHITEVEPEDIDCWCNLTSTWVTYGTCNQAGEHRRDKR

SEQ ID NO: 1049 - protein, 75 aa, synthetic construct
  REGION 1..75: note = derived and/or modified protein sequence (wt) from DENV-3 Consensus__M
SVALAPHVGMGLDTRTQTWMSAEGAWRQVEKVETWALRHPGFTILALFLAHYIGTSLTQKVVIFILLMLVTPSMT

SEQ ID NO: 1050 - protein, 166 aa, synthetic construct
  REGION 1..166: note = derived and/or modified protein sequence (wt) from DENV-3 Consensus__prM
FHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMT

SEQ ID NO: 1051 - protein, 493 aa, synthetic construct
  REGION 1..493: note = derived and/or modified protein sequence (wt) from DENV-3 Consensus__E
MRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1052 - protein, 659 aa, synthetic construct
  REGION 1..659: note = derived and/or modified protein sequence (wt) from DENV-3 Consensus__prME
FHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1053 - protein, 673 aa, synthetic construct
  REGION 1..673: note = derived and/or modified protein sequence (wt) from DENV-3 Consensus__SSc-prME
TSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1054 - protein, 352 aa, synthetic construct
  REGION 1..352: note = derived and/or modified protein sequence (wt) from DENV-3 Consensus__NS1
DMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSA

SEQ ID NO: 1055 - protein, 619 aa, synthetic construct
  REGION 1..619: note = derived and/or modified protein sequence (wt) from DENV-3 Consensus__NS3
SGVLWDVPSPPETQKAELEEGVYRIKQQGIFGKTQVGVGVQKEGVFHTMWHVTRGAVLTYNGKRLEPNWASVKKDLISYGGGWRLSAQWQKGEEVQVIAVEPGKNPKNFQTMPGTFQTTTGEIGAIALDFKPGTSGSPIINREGKVVGLYGNGVVTKNGGYVSGIAQTNAEPDGPTPELEEEMFKKRNLTIMDLHPGSGKTRKYLPAIVREAIKRRLRTLILAPTRVVAAEMEEALKGLPIRYQTTATKSEHTGREIVDLMCHATFTMRLLSPVRVPNYNLIIMDEAHFTDPASIAARGYISTRVGMGEAAAIFMTATPPGTADAFPQSNAPIQDEERDIPERSWNSGNEWITDFAGKTVWFVPSIKAGNDIANCLRKNGKKVIQLSRKTFDTEYQKTKLNDWDFVVTTDISEMGANFKADRVIDPRRCLKPVILTDGPERVILAGPMPVTAASAAQRRGRVGRNPQKENDQYIFTGQPLNNDEDHAHWTEAKMLLDNINTPEGIIPALFEPEREKSAAIDGEYRLKGESRKTFVELMRRGDLPVWLAHKVASEGIKYTDRKWCFDGQRNNQILEENMDVEIWTKEGEKKKLRPRWLDARTYSDPLALKEFKEFAAGRK

SEQ ID NO: 1056 - protein, 773 aa, synthetic construct
  REGION 1..773: note = derived and/or modified protein sequence (wt) from DENV-3 Consensus__C-prME
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1057 - protein, 15 aa, synthetic construct
  REGION 1..15: note = derived and/or modified protein sequence (wt) from DENV-3 Consensus__SSc
MTSLCLMMILPAALA

SEQ ID NO: 1058 - protein, 19 aa, synthetic construct
  REGION 1..19: note = derived and/or modified protein sequence (wt) from DENV-3 Consensus__SSopt
MKRKKTSLCLMMILPAALA

SEQ ID NO: 1059 - protein, 19 aa, synthetic construct
  REGION 1..19: note = derived and/or modified protein sequence (wt) from DENV-3 Consensus__SSm
MTQKVVIFILLMLVTPSMT

SEQ ID NO: 1060 - protein, 493 aa, synthetic construct; identical to SEQ ID NO: 1051
  REGION 1..493: note = derived and/or modified protein sequence (wt) from DENV-3 Consensus__E

SEQ ID NO: 1061 - protein, 392 aa, synthetic construct
  REGION 1..392: note = derived and/or modified protein sequence (wt) from DENV-3 Consensus__EdelTM-variant (aa1-392)
MRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKK

SEQ ID NO: 1062 - protein, 422 aa, synthetic construct
  REGION 1..422: note = derived and/or modified protein sequence (wt) from DENV-3 Consensus__EdelTM-variant (aa1-422)
MRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGS

SEQ ID NO: 1063 - protein, 419 aa, synthetic construct
  REGION 1..419: note = derived and/or modified protein sequence (wt) from DENV-3 Consensus__EdelTM-variant (aa1-419)
MRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWD

SEQ ID NO: 1064 - protein, 385 aa, synthetic construct
  REGION 1..385: note = derived and/or modified protein sequence (wt) from DENV-3 Consensus__Edelaa101-107
MRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKK

SEQ ID NO: 1065 - protein, 391 aa, synthetic construct
  REGION 1..391: note = derived and/or modified protein sequence (wt) from DENV-3 Consensus__EdelTM-variant (aa1-391)
MRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYK

SEQ ID NO: 1066 - protein, 674 aa, synthetic construct
  REGION 1..674: note = derived and/or modified protein sequence (wt) from DENV-3 Consensus__SSc-prME
MTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1067 - protein, 674 aa, synthetic construct
  REGION 1..674: note = derived and/or modified protein sequence (wt) from DENV-3 Consensus__SSc-prME(F108S)
MTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLSGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1068 - protein, 674 aa, synthetic construct
  REGION 1..674: note = derived and/or modified protein sequence (wt) from DENV-3 Consensus__SSc-prME(R186L)
MTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1069 - protein, 674 aa, synthetic construct
  REGION 1..674: note = derived and/or modified protein sequence (wt) from DENV-3 Consensus__SSc-prME(A265T)
MTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1070 - protein, 674 aa, synthetic construct
  REGION 1..674: note = derived and/or modified protein sequence (wt) from DENV-3 Consensus__SSc-prMEdelstem_TM-JEV
MTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1071 - protein, 441 aa, synthetic construct
  REGION 1..441: note = derived and/or modified protein sequence (wt) from DENV-3 Consensus__SSm-EdelTM
MTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGS

SEQ ID NO: 1072 - protein, 790 aa, synthetic construct
  REGION 1..790: note = derived and/or modified protein sequence (wt) from DENV-3 Consensus__C-P2A-SSc-prME
MNNQRKKTGKPSINMLKRVRNRVSTGSQLAKRFSKGLLNGQGPMKLVMAFIAFLRFLAIPPTAGVLARWGTFKKSGAIKVLKGFKKEISNMLSIINKRKKNFDLLKLAGDVESNPGPTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1073 - protein, 678 aa, synthetic construct
  REGION 1..678: note = derived and/or modified protein sequence (wt) from DENV-3 Consensus__SSopt-prME
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1074 - protein, 678 aa, synthetic construct
  REGION 1..678: note = derived and/or modified protein sequence (wt) from DENV-3 Consensus__SSopt-prME(F108S)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLSGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1075 - protein, 678 aa, synthetic construct
  REGION 1..678: note = derived and/or modified protein sequence (wt) from DENV-3 Consensus__SSopt-prME(H27N)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLENGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1076 - protein, 678 aa, synthetic construct
  REGION 1..678: note = derived and/or modified protein sequence (wt) from DENV-3 Consensus__SSopt-prME(T76I)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPIQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1077 - protein, 678 aa, synthetic construct
  REGION 1..678: note = derived and/or modified protein sequence (wt) from DENV-3 Consensus__SSopt-prME(N89D)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQDYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1078 - protein, 678 aa, synthetic construct
  REGION 1..678: note = derived and/or modified protein sequence (wt) from DENV-3 Consensus__SSopt-prME(Y96H)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTHVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1079 - protein, 678 aa, synthetic construct
  REGION 1..678: note = derived and/or modified protein sequence (wt) from DENV-3 Consensus__SSopt-prME(K110E)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGEGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1080 - protein, 678 aa, synthetic construct
  REGION 1..678: note = derived and/or modified protein sequence (wt) from DENV-3 Consensus__SSopt-prME(H149N)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQNQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1081 - protein, 678 aa, synthetic construct
  REGION 1..678: note = derived and/or modified protein sequence (wt) from DENV-3 Consensus__SSopt-prME(S184F)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECFPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1082 - protein, 678 aa, synthetic construct
  REGION 1..678: note = derived and/or modified protein sequence (wt) from DENV-3 Consensus__SSopt-prME(R186L)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1083 - protein, 678 aa, synthetic construct
  REGION 1..678: note = derived and/or modified protein sequence (wt) from DENV-3 Consensus__SSopt-prME(N240S)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKSAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1084 - protein, 678 aa, synthetic construct
  REGION 1..678: note = derived and/or modified protein sequence (wt) from DENV-3 Consensus__SSopt-prME(M258L)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGALHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1085 - protein, 678 aa, synthetic construct
  REGION 1..678: note = derived and/or modified protein sequence (wt) from DENV-3 Consensus__SSopt-prME(H259N)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMNTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1086 - protein, 678 aa, synthetic construct
  REGION 1..678: note = derived and/or modified protein sequence (wt) from DENV-3 Consensus__SSopt-prME(H259R)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMRTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1087 - protein, 678 aa, synthetic construct
  REGION 1..678: note = derived and/or modified protein sequence (wt) from DENV-3 Consensus__SSopt-prME(A265T)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1088 - protein, 678 aa, synthetic construct
  REGION 1..678: note = derived and/or modified protein sequence (wt) from DENV-3 Consensus__SSopt-prME(S296G)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMGYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1089 - protein, 678 aa, synthetic construct
  REGION 1..678: note = derived and/or modified protein sequence (wt) from DENV-3 Consensus__SSopt-prME(S311R)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVRETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1090 - protein, 678 aa, synthetic construct
  REGION 1..678: note = derived and/or modified protein sequence (wt) from DENV-3 Consensus__SSopt-prME(K321T)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILITVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1091 - protein, 678 aa, synthetic construct
  REGION 1..678: note = derived and/or modified protein sequence (wt) from DENV-3 Consensus__SSopt-prME(G28C,H242C)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHCGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNACAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1092 - protein, 678 aa, synthetic construct
  REGION 1..678: note = derived and/or modified protein sequence (wt) from DENV-3 Consensus__SSopt-prME(R186L,A265T)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1093 - protein, 678 aa, synthetic construct
  REGION 1..678: note = derived and/or modified protein sequence (wt) from DENV-3 Consensus__SSopt-pr(D104A)ME(F108S)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRAKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLSGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1094 - protein, 678 aa, synthetic construct
  REGION 1..678: note = derived and/or modified protein sequence (wt) from DENV-3 Consensus__SSopt-pr(D104A)ME(R186L,A265T)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRAKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1095 - protein, 678 aa, synthetic construct
  REGION 1..678: note = derived and/or modified protein sequence (wt) from DENV-3 Consensus__SSopt-pr(D104A)ME(F108S,R186L,A265T)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRAKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLSGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1096 - protein, 671 aa, synthetic construct
  REGION 1..671: note = derived and/or modified protein sequence (wt) from DENV-3 Consensus__SSopt-prMEdel101-107,(R99P,F108N)
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDPGNGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQA

SEQ ID NO: 1097 - protein, 678 aa, synthetic construct
  REGION 1..678: note = derived and/or modified protein sequence (wt) from DENV-3 Consensus__SSopt-prMEdelstem_TM-JEV
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1098 - protein, 678 aa, synthetic construct
  REGION 1..678: note = derived and/or modified protein sequence (wt) from DENV-3 Consensus__SSopt-pr(D104A)MEdelstem_TM,(F108S)-JEV
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRAKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLSGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1099 - protein, 678 aa, synthetic construct
  REGION 1..678: note = derived and/or modified protein sequence (wt) from DENV-3 Consensus__SSopt-pr(D104A)MEdelstem_TM,(R186L,A265T)-JEV
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRAKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1100 - protein, 678 aa, synthetic construct
  REGION 1..678: note = derived and/or modified protein sequence (wt) from DENV-3 Consensus__SSopt-pr(D104A)MEdelstem_TM,(F108S,R186L,A265T)- JEV
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRAKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLSGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1101 - protein, 678 aa, synthetic construct
  REGION 1..678: note = derived and/or modified protein sequence (wt) from DENV-3 Consensus__SSopt-prMEdelstem_TM,(H259N)-JEV
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMNTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1102 - protein, 678 aa, synthetic construct
  REGION 1..678: note = derived and/or modified protein sequence (wt) from DENV-3 Consensus__SSopt-prMEdelstem_TM,(R186L,A265T)-JEV
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPLTGLDFNEMILLTMKNKAWMVHRQWFFDLPLPWTSGATTETPTWNRKELLVTFKNAHAKKQEVVVLGSQEGAMHTALTGTTEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1103 - protein, 671 aa, synthetic construct
  REGION 1..671: note = derived and/or modified protein sequence (wt) from DENV-3 Consensus__SSopt-prMEdelstem_TM,del101-107,(R99P,F108N)-JEV
MKRKKTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDPGNGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 1104 - protein, 1026 aa, synthetic construct
  REGION 1..1026: note = derived and/or modified protein sequence (wt) from DENV-3 Consensus__SSc-prME-NS1
MTSLCLMMILPAALAFHLTSRDGEPRMIVGKNERGKSLLFKTASGINMCTLIAMDLGEMCDDTVTYKCPHITEVEPEDIDCWCNLTSTWVTYGTCNQAGEHRRDKRSVALAPHVGMGLDTRTQTWMSAEGAWRQVEKVETWALRHPGFTILALFLAHYIGTSLTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSVGGVLNSLGKMVHQIFGSAYTALFSGVSWVMKIGIGVLLTWIGLNSKNTSMSFSCIAIGIITLYLGAVVQADMGCVINWKGKELKCGSGIFVTNEVHTWTEQYKFQADSPKRLATAIAGAWENGVCGIRSTTRMENLLWKQIANELNYILWENNIKLTVVVGDIIGVLEQGKRTLTPQPMELKYSWKTWGKAKIVTAETQNSSFIIDGPNTPECPSVSRAWNVWEVEDYGFGVFTTNIWLKLREVYTQLCDHRLMSAAVKDERAVHADMGYWIESQKNGSWKLEKASLIEVKTCTWPKSHTLWSNGVLESDMIIPKSLAGPISQHNHRPGYHTQTAGPWHLGKLELDFNYCEGTTVVITENCGTRGPSLRTTTVSGKLIHEWCCRSCTLPPLRYMGEDGCWYGMEIRPISEKEENMVKSLVSA

SEQ ID NO: 1105 - protein, 607 aa, synthetic construct
  REGION 1..607: note = derived and/or modified protein sequence (wt) from DENV-3 Consensus__SSm-EdelTM-linker-ferritin
MTQKVVIFILLMLVTPSMTMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGSSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1106 - protein, 606 aa, synthetic construct
  REGION 1..606: note = derived and/or modified protein sequence (wt) from DENV-3 Consensus__SStPA-WHbcAg-linker-EdelTM
MDAMKRGLCCVLLLCGAVFVDSVTGMDIDPYKEFGSSYQLLNFLPLDFFPDLNALVDTATALYEEELTGREHCSPHHTAIRQALVCWDELTKLIAWMSSNITSEQVRTIIVNHVNDTWGLKVRQSLWFHLSCLTFGQHTVQEFLVSFGVWIRTPAPYRPPNAPILSTLPEHTVICGGGGSGGGGMRCVGVGNRDFVEGLSGATWVDVVLEHGGCVTTMAKNKPTLDIELQKTEATQLATLRKLCIEGKITNITTDSRCPTQGEATLPEEQDQNYVCKHTYVDRGWGNGCGLFGKGSLVTCAKFQCLEPIEGKVVQYENLKYTVIITVHTGDQHQVGNETQGVTAEITPQASTTEAILPEYGTLGLECSPRTGLDFNEMILLTMKNKAWMVHRQWFFDLPLPWTSGATTETPTWNRKELLVTFKNAHAKKQEVVVLGSQEGAMHTALTGATEIQNSGGTSIFAGHLKCRLKMDKLELKGMSYAMCTNTFVLKKEVSETQHGTILIKVEYKGEDVPCKIPFSTEDGQGKAHNGRLITANPVVTKKEEPVNIEAEPPFGESNIVIGIGDNALKINWYKKGSSIGKMFEATARGARRMAILGDTAWDFGS

SEQ ID NO: 1107 - RNA, 75 nt, synthetic construct
  misc_feature 1..75: note = derived and/or modified CDS sequence (wt) from Homo sapiens__SigSeq(TPA)/SStPA
  source 1..75: mol_type = other RNA
atggatgcaatgaagagagggctctgctgtgtgctgctgctgtgtggagcagtcttcgttgacagcgtgaccggc

SEQ ID NO: 1108 - RNA, 489 nt, synthetic construct
  misc_feature 1..489: note = derived and/or modified CDS sequence (wt) from Helicobacter pylori J99__Ferritin
  source 1..489: mol_type = other RNA
gacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcc

SEQ ID NO: 1109 - RNA, 450 nt, synthetic construct
  misc_feature 1..450: note = derived and/or modified CDS sequence (wt) from Woodchuck hepatitis virus__WHbcAg
  source 1..450: mol_type = other RNA
atggacatagatccctataaagaatttggttcatcttatcagttgttgaattttcttcctttggacttctttcctgaccttaatgctttggtggacactgctactgccttgtatgaagaagagctaacaggtagggaacattgctctccgcaccatacagctattagacaagctttagtatgctgggatgaattaactaaattgatagcttggatgagctctaacataacttctgaacaagtaagaacaatcatagtaaatcatgtcaatgatacctggggacttaaggtgagacaaagtttatggtttcatttgtcatgtctcacttttggacaacatacagttcaagaatttttagtaagttttggagtatggatcagaactccagctccatatagacctcctaatgcacccattctctcgactcttccggaacatacagtcatttgc

SEQ ID NO: 1110 - RNA, 303 nt, synthetic construct
  misc_feature 1..303: note = derived and/or modified CDS sequence (wt) from Japanese encephalitis virus__Cterm-JEV/JEV
  source 1..303: mol_type = other RNA
ggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcc

SEQ ID NO: 1111 - RNA, 15 nt, synthetic construct
  misc_feature 1..15: note = derived and/or modified CDS sequence (wt) from Artificial__MKRKK
  source 1..15: mol_type = other RNA
atgaagagaaagaaa

SEQ ID NO: 1112 - skipped

SEQ ID NO: 1113 - RNA, 27 nt, synthetic construct
  misc_feature 1..27: note = derived and/or modified CDS sequence (wt) from Artificial__Linker(G4SG4)
  source 1..27: mol_type = other RNA
ggcggcggcggctccggcggcggcggc

SEQ ID NO: 1114 - RNA, 51 nt, synthetic construct
  misc_feature 1..51: note = derived and/or modified CDS sequence (wt) from Foot-and-mouth disease virus__F2A/P2A
  source 1..51: mol_type = other RNA
aactttgaccttctcaagttggctggagacgttgagtccaatcctgggccc

SEQ ID NO: 1115 - RNA, 561 nt, synthetic construct
  misc_feature 1..561: note = derived and/or modified CDS sequence (wt) from Encephalomyocarditis virus__IRES
  source 1..561: mol_type = other RNA
cccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaacgtctaggccccccgaaccacggggacgtggttttcctttgaaaaacacgatgataat

SEQ ID NO: 1116 - RNA, 300 nt, synthetic construct
  misc_feature 1..300: note = derived and/or modified CDS sequence (wt) from DENV-1 CYD23__C
  source 1..300: mol_type = other RNA
atgaacaaccaacgaaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggagaaaa

SEQ ID NO: 1117 - RNA, 342 nt, synthetic construct
  misc_feature 1..342: note = derived and/or modified CDS sequence (wt) from DENV-1 CYD23__C-SSc
  source 1..342: mol_type = other RNA
atgaacaaccaacgaaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggagaaaatctgtgaccatgctccttatgctgatgcctacagccttggcg

SEQ ID NO: 1118 - RNA, 273 nt, synthetic construct
  misc_feature 1..273: note = derived and/or modified CDS sequence (wt) from DENV-1 CYD23__pr
  source 1..273: mol_type = other RNA
ttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgt

SEQ ID NO: 1119 - RNA, 225 nt, synthetic construct
  misc_feature 1..225: note = derived and/or modified CDS sequence (wt) from DENV-1 CYD23__M
  source 1..225: mol_type = other RNA
tccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggcc

SEQ ID NO: 1120 - RNA, 498 nt, synthetic construct
  misc_feature 1..498: note = derived and/or modified CDS sequence (wt) from DENV-1 CYD23__prM
  source 1..498: mol_type = other RNA
ttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggcc

SEQ ID NO: 1121 - RNA, 1485 nt, synthetic construct
  misc_feature 1..1485: note = derived and/or modified CDS sequence (wt) from DENV-1 CYD23__E
  source 1..1485: mol_type = other RNA
atgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcg

SEQ ID NO: 1122 - RNA, 1983 nt, synthetic construct
  misc_feature 1..1983: note = derived and/or modified CDS sequence (wt) from DENV-1 CYD23__prME
  source 1..1983: mol_type = other RNA
ttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcg

SEQ ID NO: 1123 - RNA, 2025 nt, synthetic construct
  misc_feature 1..2025: note = derived and/or modified CDS sequence (wt) from DENV-1 CYD23__SSc-prME
  source 1..2025: mol_type = other RNA
tctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcg

SEQ ID NO: 1124 - RNA, 2325 nt, synthetic construct
  misc_feature 1..2325: note = derived and/or modified CDS sequence (wt) from DENV-1 CYD23__C-prME
  source 1..2325: mol_type = other RNA
atgaacaaccaacgaaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggagaaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcg

SEQ ID NO: 1125 - RNA, 45 nt, synthetic construct
  misc_feature 1..45: note = derived and/or modified CDS sequence (wt) from DENV-1 CYD23__SSc
  source 1..45: mol_type = other RNA
atgtctgtgaccatgctccttatgctgatgcctacagccttggcg

SEQ ID NO: 1126 - RNA, 57 nt, synthetic construct
  misc_feature 1..57: note = derived and/or modified CDS sequence (wt) from DENV-1 CYD23__SSopt
  source 1..57: mol_type = other RNA
atgaagaggaagaaatctgtgaccatgctccttatgctgatgcctacagccttggcg

SEQ ID NO: 1127 - RNA, 57 nt, synthetic construct
  misc_feature 1..57: note = derived and/or modified CDS sequence (wt) from DENV-1 CYD23__SSm
  source 1..57: mol_type = other RNA
atgacccagaaagggattatcttcattttgttaatgctggttacaccatccatggcc

SEQ ID NO: 1128 - RNA, 1488 nt, synthetic construct
  misc_feature 1..1488: note = derived and/or modified CDS sequence (wt) from DENV-1 CYD23__E
  source 1..1488: mol_type = other RNA
atgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1129 - RNA, 1182 nt, synthetic construct
  misc_feature 1..1182: note = derived and/or modified CDS sequence (wt) from DENV-1 CYD23__EdelTM-variant (aa1-394)
  source 1..1182: mol_type = other RNA
atgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaa

SEQ ID NO: 1130 - RNA, 1275 nt, synthetic construct
  misc_feature 1..1275: note = derived and/or modified CDS sequence (wt) from DENV-1 CYD23__EdelTM-variant (aa1-424)
  source 1..1275: mol_type = other RNA
atgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttcttaa

SEQ ID NO: 1131 - RNA, 1266 nt, synthetic construct
  misc_feature 1..1266: note = derived and/or modified CDS sequence (wt) from DENV-1 CYD23__EdelTM-variant (aa1-421)
  source 1..1266: mol_type = other RNA
atgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactaa

SEQ ID NO: 1132 - RNA, 2031 nt, synthetic construct
  misc_feature 1..2031: note = derived and/or modified CDS sequence (wt) from DENV-1 CYD23__SSc-prME
  source 1..2031: mol_type = other RNA
atgtctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1133 - RNA, 2031 nt, synthetic construct
  misc_feature 1..2031: note = derived and/or modified CDS sequence (wt) from DENV-1 CYD23__SSc-prME(F108S)
  source 1..2031: mol_type = other RNA
atgtctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcagcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1134 - RNA, 2031 nt, synthetic construct
  misc_feature 1..2031: note = derived and/or modified CDS sequence (wt) from DENV-1 CYD23__SSc-prMEdelstem_TM-JEV
  source 1..2031: mol_type = other RNA
atgtctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1135 - RNA, 2379 nt, synthetic construct
  misc_feature 1..2379: note = derived and/or modified CDS sequence (wt) from DENV-1 CYD23__C-P2A-SSc-prME
  source 1..2379: mol_type = other RNA
atgaacaaccaacgaaaaaagacggctcgaccgtctttcaatatgctgaaacgcgcgagaaaccgcgtgtcaactgtttcacagttggcgaagagattctcaaaaggattgctttcaggccaaggacccatgaaattggtgatggctttcatagcattcctaagatttctagccatacccccaacagcaggaattttggctagatggggctcattcaagaagaatggagcgatcaaagtgctacggggtttcaagaaagaaatctcaaacatgttgaatataatgaatagaaggagaaaaaactttgaccttctcaagttggctggagacgttgagtccaatcctgggccctctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttctgacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1136 - RNA, 2043 nt, synthetic construct
  misc_feature 1..2043: note = derived and/or modified CDS sequence (wt) from DENV-1 CYD23__SSopt-prME(F108S)
  source 1..2043: mol_type = other RNA
atgaagaggaagaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcagcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1137 - RNA, 2043 nt, synthetic construct
  misc_feature 1..2043: note = derived and/or modified CDS sequence (wt) from DENV-1 CYD23__SSopt-prME(F96H)
  source 1..2043: mol_type = other RNA
atgaagaggaagaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgcacgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1138 - RNA, 2043 nt, synthetic construct
  misc_feature 1..2043: note = derived and/or modified CDS sequence (wt) from DENV-1 CYD23__SSopt-prME(S186F)
  source 1..2043: mol_type = other RNA
atgaagaggaagaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgtttccctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1139 - RNA, 2043 nt, synthetic construct
  misc_feature 1..2043: note = derived and/or modified CDS sequence (wt) from DENV-1 CYD23__SSopt-prME(R188L)
  source 1..2043: mol_type = other RNA
atgaagaggaagaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctctgacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaagggagcagcatagggaaaatgtttgaggcaactgccagaggagcacgaaggatggccatactgggagacactgcatgggactttggttctataggaggagtgttcacgtctgttggaaaattagtacaccagatttttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacctaggagtcatggttcaggcgtaa

SEQ ID NO: 1140 - RNA, 2043 nt, synthetic construct
  misc_feature 1..2043: note = derived and/or modified CDS sequence (wt) from DENV-1 CYD23__SSopt-pr(D104A)MEdelstem_TM,(F108S)-JEV
  source 1..2043: mol_type = other RNA
atgaagaggaagaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagccaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcagcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1141 - RNA, 2043 nt, synthetic construct
  misc_feature 1..2043: note = derived and/or modified CDS sequence (wt) from DENV-1 CYD23__SSopt-prMEdelstem_TM,(H261N)-JEV
  source 1..2043: mol_type = other RNA
atgaagaggaagaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgaacactgcgttgaccggagcgacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1142 - RNA, 2043 nt, synthetic construct
  misc_feature 1..2043: note = derived and/or modified CDS sequence (wt) from DENV-1 CYD23__SSopt-prMEdelstem_TM,(R188L,A267T)-JEV
  source 1..2043: mol_type = other RNA
atgaagaggaagaaatctgtgaccatgctccttatgctgatgcctacagccttggcgttccatttgacaacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctagaatcactgaggcggaaccagatgacgttgattgttggtgcaatgccacagacacatgggtgacctatggaacgtgttctcaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactactatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgaccgactacggagctcttacattggattgttcacctctgacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggaaccacagaaatccaaacgtctggaacgacaacaatttttgcaggacacttgaaatgtagattaaagatggacaaactgactctaaaagggatgtcatatgtgatgtgtacaggctcattcaagctagagaaagaagtggctgagacccagcatggaaccgttctagtgcagattaaatacgaaggaacagatgcaccatgcaagatccctttttcgacccaagatgaaaaaggagtaacccaaaatgggagattgataacagccaaccctatagtcactgacaaagaaaaaccagtcaacattgaggcagaaccgccttttggtgagagttacatcgtgataggagcaggtgaaaaagctttaaaactaagctggttcaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1143 - RNA, 300 nt, synthetic construct
  misc_feature 1..300: note = derived and/or modified CDS sequence (wt) from DENV-2 CYD2-T__C
  source 1..300: mol_type = other RNA
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcaga

SEQ ID NO: 1144 - RNA, 342 nt, synthetic construct
  misc_feature 1..342: note = derived and/or modified CDS sequence (wt) from DENV-2 CYD2-T__C-SSc
  source 1..342: mol_type = other RNA
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcg

SEQ ID NO: 1145 - RNA, 273 nt, synthetic construct
  misc_feature 1..273: note = derived and/or modified CDS sequence (wt) from DENV-2 CYD2-T__pr
  source 1..273: mol_type = other RNA
ttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaaga

SEQ ID NO: 1146 - RNA, 225 nt, synthetic construct
  misc_feature 1..225: note = derived and/or modified CDS sequence (wt) from DENV-2 CYD2-T__M
  source 1..225: mol_type = other RNA
tcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgaca

SEQ ID NO: 1147 - RNA, 498 nt, synthetic construct
  misc_feature 1..498: note = derived and/or modified CDS sequence (wt) from DENV-2 CYD2-T__prM
  source 1..498: mol_type = other RNA
ttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgaca

SEQ ID NO: 1148 - RNA, 1485 nt, synthetic construct
  misc_feature 1..1485: note = derived and/or modified CDS sequence (wt) from DENV-2 CYD2-T__E
  source 1..1485: mol_type = other RNA
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcc

SEQ ID NO: 1149 - RNA, 1983 nt, synthetic construct
  misc_feature 1..1983: note = derived and/or modified CDS sequence (wt) from DENV-2 CYD2-T__prME
  source 1..1983: mol_type = other RNA
ttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcc

SEQ ID NO: 1150 - RNA, 2025 nt, synthetic construct
  misc_feature 1..2025: note = derived and/or modified CDS sequence (wt) from DENV-2 CYD2-T__SSc-prME
  source 1..2025: mol_type = other RNA
tctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcc

SEQ ID NO: 1151 - RNA, 2325 nt, synthetic construct
  misc_feature 1..2325: note = derived and/or modified CDS sequence (wt) from DENV-2 CYD2-T__C-prME
  source 1..2325: mol_type = other RNA
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcc

SEQ ID NO: 1152 - RNA, 45 nt, synthetic construct
  misc_feature 1..45: note = derived and/or modified CDS sequence (wt) from DENV-2 CYD2-T__SSc
  source 1..45: mol_type = other RNA
atgtctgcaggcatgatcattatgctgattccaacagtgatggcg

SEQ ID NO: 1153 - RNA, 57 nt, synthetic construct
  misc_feature 1..57: note = derived and/or modified CDS sequence (wt) from DENV-2 CYD2-T__SSopt
  source 1..57: mol_type = other RNA
atgaagaggaagaaatctgcaggcatgatcattatgctgattccaacagtgatggcg

SEQ ID NO: 1154 - RNA, 57 nt, synthetic construct
  misc_feature 1..57: note = derived and/or modified CDS sequence (wt) from DENV-2 CYD2-T__SSm
  source 1..57: mol_type = other RNA
atgttccaaagagccctgattttcatcttactgacagctgtcactccttcaatgaca

SEQ ID NO: 1155 - RNA, 1488 nt, synthetic construct
  misc_feature 1..1488: note = derived and/or modified CDS sequence (wt) from DENV-2 CYD2-T__E
  source 1..1488: mol_type = other RNA
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1156 - RNA, 1182 nt, synthetic construct
  misc_feature 1..1182: note = derived and/or modified CDS sequence (wt) from DENV-2 CYD2-T__EdelTM-variant (aa1-394)
  source 1..1182: mol_type = other RNA
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaa

SEQ ID NO: 1157 - RNA, 1272 nt, synthetic construct
  misc_feature 1..1272: note = derived and/or modified CDS sequence (wt) from DENV-2 CYD2-T__EdelTM-variant (aa1-424)
  source 1..1272: mol_type = other RNA
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatcc

SEQ ID NO: 1158 - RNA, 1263 nt, synthetic construct
  misc_feature 1..1263: note = derived and/or modified CDS sequence (wt) from DENV-2 CYD2-T__EdelTM-variant (aa1-421)
  source 1..1263: mol_type = other RNA
atgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggat

SEQ ID NO: 1159 - RNA, 2031 nt, synthetic construct
  misc_feature 1..2031: note = derived and/or modified CDS sequence (wt) from DENV-2 CYD2-T__SSc-prME
  source 1..2031: mol_type = other RNA
atgtctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1160 - RNA, 2031 nt, synthetic construct
  misc_feature 1..2031: note = derived and/or modified CDS sequence (wt) from DENV-2 CYD2-T__SSc-prME(F108S)
  source 1..2031: mol_type = other RNA
atgtctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactaagcggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1161 - RNA, 2031 nt, synthetic construct
  misc_feature 1..2031: note = derived and/or modified CDS sequence (wt) from DENV-2 CYD2-T__SSc-prMEdelstem_TM-JEV
  source 1..2031: mol_type = other RNA
atgtctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1162 - RNA, 1332 nt, synthetic construct
  misc_feature 1..1332: note = derived and/or modified CDS sequence (wt) from DENV-2 CYD2-T__SSm-EdelTM
  source 1..1332: mol_type = other RNA
atgttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatcctaa

SEQ ID NO: 1163 - RNA, 2379 nt, synthetic construct
  misc_feature 1..2379: note = derived and/or modified CDS sequence (wt) from DENV-2 CYD2-T__C-P2A-SSc-prME
  source 1..2379: mol_type = other RNA
atgaataaccaacggaaaaaggcgaaaaacacgcctttcaatatgctgaaacgcgagagaaaccgcgtgtcgactgtgcaacagctgacaaagagattctcacttggaatgctgcagggacgaggaccattaaaactgttcatggccctggtggcgttccttcgtttcctaacaatcccaccaacagcagggatattgaagagatggggaacaattaaaaaatcaaaagctattaatgttttgagagggttcaggaaagagattggaaggatgctgaacatcttgaataggagacgcagaaactttgaccttctcaagttggctggagacgttgagtccaatcctgggccctctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1164 - RNA, 2043 nt, synthetic construct
  misc_feature 1..2043: note = derived and/or modified CDS sequence (wt) from DENV-2 CYD2-T__SSopt-prME(F108S)
  source 1..2043: mol_type = other RNA
atgaagaggaagaaatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactaagcggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1165 - RNA, 2043 nt, synthetic construct
  misc_feature 1..2043: note = derived and/or modified CDS sequence (wt) from DENV-2 CYD2-T__SSopt-prME(M96H)
  source 1..2043: mol_type = other RNA
atgaagaggaagaaatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactcccacgtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1166 - RNA, 2043 nt, synthetic construct
  misc_feature 1..2043: note = derived and/or modified CDS sequence (wt) from DENV-2 CYD2-T__SSopt-prME(S186F)
  source 1..2043: mol_type = other RNA
atgaagaggaagaaatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgcttcccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1167 - RNA, 2043 nt, synthetic construct
  misc_feature 1..2043: note = derived and/or modified CDS sequence (wt) from DENV-2 CYD2-T__SSopt-prME(R188L)
  source 1..2043: mol_type = other RNA
atgaagaggaagaaatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccactgacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggaagttctatcggccaaatgtttgagacaacaatgaggggggcgaagagaatggccattttaggtgacacagcctgggattttggatccttgggaggagtgtttacatctataggaaaggctctccaccaagtctttggagcaatctatggagctgccttcagtggggtttcatggactatgaaaatcctcataggagtcattatcacatggataggaatgaatagccgcagcacctcactgtctgtgacactagtattggtgggaattgtgacactgtatttgggagtcatggtgcaggcctaa

SEQ ID NO: 1168 - RNA, 2043 nt, synthetic construct
  misc_feature 1..2043: note = derived and/or modified CDS sequence (wt) from DENV-2 CYD2-T__SSopt-pr(D104A)MEdelstem_TM,(F108S)-JEV
  source 1..2043: mol_type = other RNA
atgaagaggaagaaatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagccaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactaagcggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1169 - RNA, 2043 nt, synthetic construct
  misc_feature 1..2043: note = derived and/or modified CDS sequence (wt) from DENV-2 CYD2-T__SSopt-prMEdelstem_TM,(H261N)-JEV
  source 1..2043: mol_type = other RNA
atgaagaggaagaaatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccaagaacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgaacacagcacttacaggggccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1170 - RNA, 2043 nt, synthetic construct
  misc_feature 1..2043: note = derived and/or modified CDS sequence (wt) from DENV-2 CYD2-T__SSopt-prMEdelstem_TM,(R188L,A267T)-JEV
  source 1..2043: mol_type = other RNA
atgaagaggaagaaatctgcaggcatgatcattatgctgattccaacagtgatggcgttccatttaaccacacgtaacggagaaccacacatgatcgtcagcagacaagagaaagggaaaagtcttctgtttaaaacagaggatggcgtgaacatgtgtaccctcatggccatggaccttggtgaattgtgtgaagacacaatcacgtacaagtgtccccttctcaggcagaatgagccagaagacatagactgttggtgcaactctacgtccacgtgggtaacttatgggacgtgtaccaccatgggagaacatagaagagaaaaaagatcagtggcactcgttccacatgtgggaatgggactggagacacgaactgaaacatggatgtcatcagaaggggcctggaaacatgtccagagaattgaaacttggatcttgagacatccaggcttcaccatgatggcagcaatcctggcatacaccataggaacgacacatttccaaagagccctgattttcatcttactgacagctgtcactccttcaatgacaatgcgttgcataggaatgtcaaatagagactttgtggaaggggtttcaggaggaagctgggttgacatagtcttagaacatggaagctgtgtgacgacgatggcaaaaaacaaaccaacattggattttgaactgataaaaacagaagccaaacagcctgccaccctaaggaagtactgtatagaggcaaagctaaccaacacaacaacagaatctcgctgcccaacacaaggggaacccagcctaaatgaagagcaggacaaaaggttcgtctgcaaacactccatggtagacagaggatggggaaatggatgtggactatttggaaagggaggcattgtgacctgtgctatgttcagatgcaaaaagaacatggaaggaaaagttgtgcaaccagaaaacttggaatacaccattgtgataacacctcactcaggggaagagcatgcagtcggaaatgacacaggaaaacatggcaaggaaatcaaaataacaccacagagttccatcacagaagcagaattgacaggttatggcactgtcacaatggagtgctctccactgacgggcctcgacttcaatgagatggtgttgctgcagatggaaaataaagcttggctggtgcacaggcaatggttcctagacctgccgttaccatggttgcccggagcggacacacaagggtcaaattggatacagaaagagacattggtcactttcaaaaatccccatgcgaagaaacaggatgttgttgttttaggatcccaagaaggggccatgcacacagcacttacagggaccacagaaatccaaatgtcatcaggaaacttactcttcacaggacatctcaagtgcaggctgagaatggacaagctacagctcaaaggaatgtcatactctatgtgcacaggaaagtttaaagttgtgaaggaaatagcagaaacacaacatggaacaatagttatcagagtgcaatatgaaggggacggctctccatgcaagatcccttttgagataatggatttggaaaaaagacatgtcttaggtcgcctgattacagtcaacccaattgtgacagaaaaagatagcccagtcaacatagaagcagaacctccattcggagacagctacatcatcataggagtagagccgggacaactgaagctcaactggtttaagaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1171 - RNA, 297 nt, synthetic construct
  misc_feature 1..297: note = derived and/or modified CDS sequence (wt) from DENV-4 Consensus__C
  source 1..297: mol_type = other RNA
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaagg

SEQ ID NO: 1172 - RNA, 339 nt, synthetic construct
  misc_feature 1..339: note = derived and/or modified CDS sequence (wt) from DENV-4 Consensus__C-SSc
  source 1..339: mol_type = other RNA
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcg

SEQ ID NO: 1173 - RNA, 273 nt, synthetic construct
  misc_feature 1..273: note = derived and/or modified CDS sequence (wt) from DENV-4 Consensus__pr
  source 1..273: mol_type = other RNA
tttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgc

SEQ ID NO: 1174 - RNA, 225 nt, synthetic construct
  misc_feature 1..225: note = derived and/or modified CDS sequence (wt) from DENV-4 Consensus__M
  source 1..225: mol_type = other RNA
tcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacgga

SEQ ID NO: 1175 - RNA, 498 nt, synthetic construct
  misc_feature 1..498: note = derived and/or modified CDS sequence (wt) from DENV-4 Consensus__prM
  source 1..498: mol_type = other RNA
tttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacgga

SEQ ID NO: 1176 - RNA, 1485 nt, synthetic construct
  misc_feature 1..1485: note = derived and/or modified CDS sequence (wt) from DENV-4 Consensus__E
  source 1..1485: mol_type = other RNA
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcg

SEQ ID NO: 1177 - RNA, 1983 nt, synthetic construct
  misc_feature 1..1983: note = derived and/or modified CDS sequence (wt) from DENV-4 Consensus__prME
  source 1..1983: mol_type = other RNA
tttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcg

SEQ ID NO: 1178 - RNA, 2025 nt, synthetic construct
  misc_feature 1..2025: note = derived and/or modified CDS sequence (wt) from DENV-4 Consensus__SSc-prME
  source 1..2025: mol_type = other RNA
tcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcg

SEQ ID NO: 1179 - RNA, 2322 nt, synthetic construct
  misc_feature 1..2322: note = derived and/or modified CDS sequence (wt) from DENV-4 Consensus__C-prME
  source 1..2322: mol_type = other RNA
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcg

SEQ ID NO: 1180 - RNA, 45 nt, synthetic construct
  misc_feature 1..45: note = derived and/or modified CDS sequence (wt) from DENV-4 Consensus__SSc
  source 1..45: mol_type = other RNA
atgtcaacgataacattgttgtgcttgattcccaccgtaatggcg

SEQ ID NO: 1181 - RNA, 57 nt, synthetic construct
  misc_feature 1..57: note = derived and/or modified CDS sequence (wt) from DENV-4 Consensus__SSopt
  source 1..57: mol_type = other RNA
atgaagaggaagaaatcaacgataacattgttgtgcttgattcccaccgtaatggcg

SEQ ID NO: 1182 - RNA, 57 nt, synthetic construct
  misc_feature 1..57: note = derived and/or modified CDS sequence (wt) from DENV-4 Consensus__SSm
  source 1..57: mol_type = other RNA
atgatccagcgaactgtcttctttgtcctaatgatgctggtcgccccatcctacgga

SEQ ID NO: 1183 - RNA, 1488 nt, synthetic construct
  misc_feature 1..1488: note = derived and/or modified CDS sequence (wt) from DENV-4 Consensus__E
  source 1..1488: mol_type = other RNA
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1184 - RNA, 1182 nt, synthetic construct
  misc_feature 1..1182: note = derived and/or modified CDS sequence (wt) from DENV-4 Consensus__EdelTM-variant (aa1-394)
  source 1..1182: mol_type = other RNA
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaa

SEQ ID NO: 1185 - RNA, 1272 nt, synthetic construct
  misc_feature 1..1272: note = derived and/or modified CDS sequence (wt) from DENV-4 Consensus__EdelTM-variant (aa1-424)
  source 1..1272: mol_type = other RNA
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttcc

SEQ ID NO: 1186 - RNA, 1266 nt, synthetic construct
  misc_feature 1..1266: note = derived and/or modified CDS sequence (wt) from DENV-4 Consensus__EdelTM-variant (aa1-421)
  source 1..1266: mol_type = other RNA
atgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattaa

SEQ ID NO: 1187 - RNA, 2031 nt, synthetic construct
  misc_feature 1..2031: note = derived and/or modified CDS sequence (wt) from DENV-4 Consensus__SSc-prME
  source 1..2031: mol_type = other RNA
atgtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1188 - RNA, 2031 nt, synthetic construct
  misc_feature 1..2031: note = derived and/or modified CDS sequence (wt) from DENV-4 Consensus__SSc-prME(F108S)
  source 1..2031: mol_type = other RNA
atgtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgagcggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1189 - RNA, 2031 nt, synthetic construct
  misc_feature 1..2031: note = derived and/or modified CDS sequence (wt) from DENV-4 Consensus__SSc-prMEdelstem_TM-JEV
  source 1..2031: mol_type = other RNA
atgtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1190 - RNA, 1332 nt, synthetic construct
  misc_feature 1..1332: note = derived and/or modified CDS sequence (wt) from DENV-4 Consensus__SSm-EdelTM
  source 1..1332: mol_type = other RNA
atgatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttcctaa

SEQ ID NO: 1191 - RNA, 2376 nt, synthetic construct
  misc_feature 1..2376: note = derived and/or modified CDS sequence (wt) from DENV-4 Consensus__C-P2A-SSc-prME
  source 1..2376: mol_type = other RNA
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggaactttgaccttctcaagttggctggagacgttgagtccaatcctgggccctcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1192 - RNA, 2043 nt, synthetic construct
  misc_feature 1..2043: note = derived and/or modified CDS sequence (wt) from DENV-4 Consensus__SSopt-prME(F108S)
  source 1..2043: mol_type = other RNA
atgaagaggaagaaatcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgagcggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1193 - RNA, 2043 nt, synthetic construct
  misc_feature 1..2043: note = derived and/or modified CDS sequence (wt) from DENV-4 Consensus__SSopt-prME(V96H)
  source 1..2043: mol_type = other RNA
atgaagaggaagaaatcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatcacgtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1194 - RNA, 2043 nt, synthetic construct
  misc_feature 1..2043: note = derived and/or modified CDS sequence (wt) from DENV-4 Consensus__SSopt-prME(E186F)
  source 1..2043: mol_type = other RNA
atgaagaggaagaaatcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtttccccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1195 - RNA, 2043 nt, synthetic construct
  misc_feature 1..2043: note = derived and/or modified CDS sequence (wt) from DENV-4 Consensus__SSopt-prME(R188L)
  source 1..2043: mol_type = other RNA
atgaagaggaagaaatcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccctgtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcgtaa

SEQ ID NO: 1196 - RNA, 2043 nt, synthetic construct
  misc_feature 1..2043: note = derived and/or modified CDS sequence (wt) from DENV-4 Consensus__SSopt-pr(D104A)MEdelstem_TM,(F108S)-JEV
  source 1..2043: mol_type = other RNA
atgaagaggaagaaatcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagccaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgagcggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1197 - RNA, 2043 nt, synthetic construct
  misc_feature 1..2043: note = derived and/or modified CDS sequence (wt) from DENV-4 Consensus__SSopt-prMEdelstem_TM,(H261N)-JEV
  source 1..2043: mol_type = other RNA
atgaagaggaagaaatcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgaactctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1198 - RNA, 2043 nt, synthetic construct
  misc_feature 1..2043: note = derived and/or modified CDS sequence (wt) from DENV-4 Consensus__SSopt-prMEdelstem_TM,(R188L,A267T)-JEV
  source 1..2043: mol_type = other RNA
atgaagaggaagaaatcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgattgtgaacccctgtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggaaccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaaggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1199 - RNA, 300 nt, synthetic construct
  misc_feature 1..300: note = derived and/or modified CDS sequence (wt) from DENV-3 Consensus__C
  source 1..300: mol_type = other RNA
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggctatcaaggtcctgaaaggcttcaagaaggagatctcaaacatgctgagtataatcaacaaacggaaaaag

SEQ ID NO: 1200 - RNA, 342 nt, synthetic construct
  misc_feature 1..342: note = derived and/or modified CDS sequence (wt) from DENV-3 Consensus__C-SSc
  source 1..342: mol_type = other RNA
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggctatcaaggtcctgaaaggcttcaagaaggagatctcaaacatgctgagtataatcaacaaacggaaaaagacatcgctctgtctcatgatgatattgccagcagcacttgct

SEQ ID NO: 1201 - RNA, 273 nt, synthetic construct
  misc_feature 1..273: note = derived and/or modified CDS sequence (wt) from DENV-3 Consensus__pr
  source 1..273: mol_type = other RNA
ttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagaga

SEQ ID NO: 1202 - RNA, 225 nt, synthetic construct
  misc_feature 1..225: note = derived and/or modified CDS sequence (wt) from DENV-3 Consensus__M
  source 1..225: mol_type = other RNA
tcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgaca

SEQ ID NO: 1203 - RNA, 498 nt, synthetic construct
  misc_feature 1..498: note = derived and/or modified CDS sequence (wt) from DENV-3 Consensus__prM
  source 1..498: mol_type = other RNA
ttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgaca

SEQ ID NO: 1204 - RNA, 1479 nt, synthetic construct
  misc_feature 1..1479: note = derived and/or modified CDS sequence (wt) from DENV-3 Consensus__E
  source 1..1479: mol_type = other RNA
atgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagct

SEQ ID NO: 1205 - RNA, 1977 nt, synthetic construct
  misc_feature 1..1977: note = derived and/or modified CDS sequence (wt) from DENV-3 Consensus__prME
  source 1..1977: mol_type = other RNA
ttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagct

SEQ ID NO: 1206 - RNA, 2019 nt, synthetic construct
  misc_feature 1..2019: note = derived and/or modified CDS sequence (wt) from DENV-3 Consensus__SSc-prME
  source 1..2019: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagct

SEQ ID NO: 1207 - RNA, 1056 nt, synthetic construct
  misc_feature 1..1056: note = derived and/or modified CDS sequence (wt) from DENV-3 Consensus__NS1
  source 1..1056: mol_type = other RNA
gacatggggtgtgttataaactggaaaggcaaagaactcaaatgtggaagtggaatcttcgtcaccaacgaagtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggtagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagct

SEQ ID NO: 1208 - RNA, 1857 nt, synthetic construct
  misc_feature 1..1857: note = derived and/or modified CDS sequence (wt) from DENV-3 Consensus__NS3
  source 1..1857: mol_type = other RNA
tccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaag

SEQ ID NO: 1209 - RNA, 2319 nt, synthetic construct
  misc_feature 1..2319: note = derived and/or modified CDS sequence (wt) from DENV-3 Consensus__C-prME
  source 1..2319: mol_type = other RNA
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggctatcaaggtcctgaaaggcttcaagaaggagatctcaaacatgctgagtataatcaacaaacggaaaaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagct

SEQ ID NO: 1210 - RNA, 45 nt, synthetic construct
  misc_feature 1..45: note = derived and/or modified CDS sequence (wt) from DENV-3 Consensus__SSc
  source 1..45: mol_type = other RNA
atgacatcgctctgtctcatgatgatattgccagcagcacttgct

SEQ ID NO: 1211 - RNA, 57 nt, synthetic construct
  misc_feature 1..57: note = derived and/or modified CDS sequence (wt) from DENV-3 Consensus__SSopt
  source 1..57: mol_type = other RNA
atgaagaggaagaaaacatcgctctgtctcatgatgatattgccagcagcacttgct

SEQ ID NO: 1212 - RNA, 57 nt, synthetic construct
  misc_feature 1..57: note = derived and/or modified CDS sequence (wt) from DENV-3 Consensus__SSm
  source 1..57: mol_type = other RNA
atgacccagaaggtggttatttttatactactaatgctggtcaccccatccatgaca

SEQ ID NO: 1213 - RNA, 1482 nt, synthetic construct
  misc_feature 1..1482: note = derived and/or modified CDS sequence (wt) from DENV-3 Consensus__E
  source 1..1482: mol_type = other RNA
atgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1214 - RNA, 1176 nt, synthetic construct
  misc_feature 1..1176: note = derived and/or modified CDS sequence (wt) from DENV-3 Consensus__EdelTM-variant (aa1-392)
  source 1..1176: mol_type = other RNA
atgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaag

SEQ ID NO: 1215 - RNA, 1269 nt, synthetic construct
  misc_feature 1..1269: note = derived and/or modified CDS sequence (wt) from DENV-3 Consensus__EdelTM-variant (aa1-422)
  source 1..1269: mol_type = other RNA
atgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcataa

SEQ ID NO: 1216 - RNA, 1260 nt, synthetic construct
  misc_feature 1..1260: note = derived and/or modified CDS sequence (wt) from DENV-3 Consensus__EdelTM-variant (aa1-419)
  source 1..1260: mol_type = other RNA
atgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactaa

SEQ ID NO: 1217 - RNA, 1155 nt, synthetic construct
  misc_feature 1..1155: note = derived and/or modified CDS sequence (wt) from DENV-3 Consensus__Edelaa101-107
  source 1..1155: mol_type = other RNA
atgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaag

SEQ ID NO: 1218 - RNA, 1173 nt, synthetic construct
  misc_feature 1..1173: note = derived and/or modified CDS sequence (wt) from DENV-3 Consensus__EdelTM-variant (aa1-391)
  source 1..1173: mol_type = other RNA
atgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataag

SEQ ID NO: 1219 - RNA, 2025 nt, synthetic construct
  misc_feature 1..2025: note = derived and/or modified CDS sequence (wt) from DENV-3 Consensus__SSc-prME
  source 1..2025: mol_type = other RNA
atgacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1220 - RNA, 2025 nt, synthetic construct
  misc_feature 1..2025: note = derived and/or modified CDS sequence (wt) from DENV-3 Consensus__SSc-prME(F108S)
  source 1..2025: mol_type = other RNA
atgacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgagcggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1221 - RNA, 2025 nt, synthetic construct
  misc_feature 1..2025: note = derived and/or modified CDS sequence (wt) from DENV-3 Consensus__SSc-prME(R186L)
  source 1..2025: mol_type = other RNA
atgacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1222 - RNA, 2025 nt, synthetic construct
  misc_feature 1..2025: note = derived and/or modified CDS sequence (wt) from DENV-3 Consensus__SSc-prME(A265T)
  source 1..2025: mol_type = other RNA
atgacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1223 - RNA, 2025 nt, synthetic construct
  misc_feature 1..2025: note = derived and/or modified CDS sequence (wt) from DENV-3 Consensus__SSc-prMEdelstem_TM-JEV
  source 1..2025: mol_type = other RNA
atgacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1224 - RNA, 1326 nt, synthetic construct
  misc_feature 1..1326: note = derived and/or modified CDS sequence (wt) from DENV-3 Consensus__SSm-EdelTM
  source 1..1326: mol_type = other RNA
atgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcataa

SEQ ID NO: 1225 - RNA, 2373 nt, synthetic construct
  misc_feature 1..2373: note = derived and/or modified CDS sequence (wt) from DENV-3 Consensus__C-P2A-SSc-prME
  source 1..2373: mol_type = other RNA
atgaacaaccaacggaagaagacgggaaaaccgtctatcaatatgctgaaacgcgtgagaaaccgtgtgtcaactggatcacagttggcgaagagattctcaaaaggattgctgaacggccagggaccaatgaaattggttatggcgttcatagctttcctcagatttctagccattccaccaacagcaggagtcttggctagatggggaaccttcaagaagtcgggggctatcaaggtcctgaaaggcttcaagaaggagatctcaaacatgctgagtataatcaacaaacggaaaaagaactttgaccttctcaagttggctggagacgttgagtccaatcctgggcccacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1226 - RNA, 2037 nt, synthetic construct
  misc_feature 1..2037: note = derived and/or modified CDS sequence (wt) from DENV-3 Consensus__SSopt-prME
  source 1..2037: mol_type = other RNA
atgaagaggaagaaaacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1227 - RNA, 2037 nt, synthetic construct
  misc_feature 1..2037: note = derived and/or modified CDS sequence (wt) from DENV-3 Consensus__SSopt-prME(F108S)
  source 1..2037: mol_type = other RNA
atgaagaggaagaaaacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgagcggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1228 - RNA, 2037 nt, synthetic construct
  misc_feature 1..2037: note = derived and/or modified CDS sequence (wt) from DENV-3 Consensus__SSopt-prME(H27N)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagaacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1229 - RNA, 2037 nt, synthetic construct
  misc_feature 1..2037: note = derived and/or modified CDS sequence (wt) from DENV-3 Consensus__SSopt-prME(T76I)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctatccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1230 - RNA, 2037 nt, synthetic construct
  misc_feature 1..2037: note = derived and/or modified CDS sequence (wt) from DENV-3 Consensus__SSopt-prME(N89D)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaagactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1231 - RNA, 2037 nt, synthetic construct
  misc_feature 1..2037: note = derived and/or modified CDS sequence (wt) from DENV-3 Consensus__SSopt-prME(Y96H)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacacacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1232 - RNA, 2037 nt, synthetic construct
  misc_feature 1..2037: note = derived and/or modified CDS sequence (wt) from DENV-3 Consensus__SSopt-prME(K110E)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcgagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1233 - RNA, 2037 nt, synthetic construct
  misc_feature 1..2037: note = derived and/or modified CDS sequence (wt) from DENV-3 Consensus__SSopt-prME(H149N)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaaaaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1234 - RNA, 2037 nt, synthetic construct
  misc_feature 1..2037: note = derived and/or modified CDS sequence (wt) from DENV-3 Consensus__SSopt-prME(S184F)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgcttcccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1235 - RNA, 2037 nt, synthetic construct
  misc_feature 1..2037: note = derived and/or modified CDS sequence (wt) from DENV-3 Consensus__SSopt-prME(R186L)
  source 1..2037: mol_type = other RNA
atgaagaggaagaaaacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1236 - RNA, 2037 nt, synthetic construct
  misc_feature 1..2037: note = derived and/or modified CDS sequence (wt) from DENV-3 Consensus__SSopt-prME(N240S)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaagcgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1237 - RNA, 2037 nt, synthetic construct
  misc_feature 1..2037: note = derived and/or modified CDS sequence (wt) from DENV-3 Consensus__SSopt-prME(M258L)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcactgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1238 - RNA, 2037 nt, synthetic construct
  misc_feature 1..2037: note = derived and/or modified CDS sequence (wt) from DENV-3 Consensus__SSopt-prME(H259N)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgaacaccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1239 - RNA, 2037 nt, synthetic construct
  misc_feature 1..2037: note = derived and/or modified CDS sequence (wt) from DENV-3 Consensus__SSopt-prME(H259R)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgaggaccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1240 - RNA, 2037 nt, synthetic construct
  misc_feature 1..2037: note = derived and/or modified CDS sequence (wt) from DENV-3 Consensus__SSopt-prME(A265T)
  source 1..2037: mol_type = other RNA
atgaagaggaagaaaacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1241 - RNA, 2037 nt, synthetic construct
  misc_feature 1..2037: note = derived and/or modified CDS sequence (wt) from DENV-3 Consensus__SSopt-prME(S296G)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgggctatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1242 - RNA, 2037 nt, synthetic construct
  misc_feature 1..2037: note = derived and/or modified CDS sequence (wt) from DENV-3 Consensus__SSopt-prME(S311R)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtcagagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1243 - RNA, 2037 nt, synthetic construct
  misc_feature 1..2037: note = derived and/or modified CDS sequence (wt) from DENV-3 Consensus__SSopt-prME(K321T)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaccgtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1244 - RNA, 2037 nt, synthetic construct
  misc_feature 1..2037: note = derived and/or modified CDS sequence (wt) from DENV-3 Consensus__SSopt-prME(G28C,H242C)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcactgcgggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcatgcgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1245 - RNA, 2037 nt, synthetic construct
  misc_feature 1..2037: note = derived and/or modified CDS sequence (wt) from DENV-3 Consensus__SSopt-prME(R186L,A265T)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1246 - RNA, 2037 nt, synthetic construct
  misc_feature 1..2037: note = derived and/or modified CDS sequence (wt) from DENV-3 Consensus__SSopt-pr(D104A)ME(F108S)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgccaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgagcggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1247 - RNA, 2037 nt, synthetic construct
  misc_feature 1..2037: note = derived and/or modified CDS sequence (wt) from DENV-3 Consensus__SSopt-pr(D104A)ME(R186L,A265T)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgccaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1248 - RNA, 2037 nt, synthetic construct
  misc_feature 1..2037: note = derived and/or modified CDS sequence (wt) from DENV-3 Consensus__SSopt-pr(D104A)ME(F108S,R186L,A265T)
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgccaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgagcggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1249 - RNA, 2016 nt, synthetic construct
  misc_feature 1..2016: note = derived and/or modified CDS sequence (wt) from DENV-3 Consensus__SSopt-prMEdel101-107,(R99P,F108N)
  source 1..2016: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagaccccggcaacggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagcttaa

SEQ ID NO: 1250 - RNA, 2037 nt, synthetic construct
  misc_feature 1..2037: note = derived and/or modified CDS sequence (wt) from DENV-3 Consensus__SSopt-prMEdelstem_TM-JEV
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1251 - RNA, 2037 nt, synthetic construct
  misc_feature 1..2037: note = derived and/or modified CDS sequence (wt) from DENV-3 Consensus__SSopt-pr(D104A)MEdelstem_TM,(F108S)-JEV
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgccaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgagcggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1252 - RNA, 2037 nt, synthetic construct
  misc_feature 1..2037: note = derived and/or modified CDS sequence (wt) from DENV-3 Consensus__SSopt-pr(D104A)MEdelstem_TM,(R186L,A265T)-JEV
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgccaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1253 - RNA, 2037 nt, synthetic construct
  misc_feature 1..2037: note = derived and/or modified CDS sequence (wt) from DENV-3 Consensus__SSopt-pr(D104A)MEdelstem_TM,(F108S,R186L,A265T)- JEV
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgccaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgagcggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1254 - RNA, 2037 nt, synthetic construct
  misc_feature 1..2037: note = derived and/or modified CDS sequence (wt) from DENV-3 Consensus__SSopt-prMEdelstem_TM,(H259N)-JEV
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgaacaccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1255 - RNA, 2037 nt, synthetic construct
  misc_feature 1..2037: note = derived and/or modified CDS sequence (wt) from DENV-3 Consensus__SSopt-prMEdelstem_TM,(R186L,A265T)-JEV
  source 1..2037: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccactgacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggaaccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1256 - RNA, 2016 nt, synthetic construct
  misc_feature 1..2016: note = derived and/or modified CDS sequence (wt) from DENV-3 Consensus__SSopt-prMEdelstem_TM,del101-107,(R99P,F108N)-JEV
  source 1..2016: mol_type = other RNA
atgaagcgcaagaagacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagaccccggcaacggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggcagcacgctgggcaaggccttttcaacaactttgaagggagctcaaagactggcagcgttgggcgacacagcctgggactttggctctattggaggggtcttcaactccataggaagagccgttcaccaagtgtttggtggtgccttcagaacactctttgggggaatgtcttggatcacacaagggctaatgggtgccctactgctctggatgggcgtcaacgcacgagaccgatcaattgctttggccttcttagccacaggaggtgtgctcgtgttcttagcgaccaatgtgcacgcctaa

SEQ ID NO: 1257 - RNA, 3081 nt, synthetic construct
  misc_feature 1..3081: note = derived and/or modified CDS sequence (wt) from DENV-3 Consensus__SSc-prME-NS1
  source 1..3081: mol_type = other RNA
atgacatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaagtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggtagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcttaa

SEQ ID NO: 1258 - RNA, 1824 nt, synthetic construct
  misc_feature 1..1824: note = derived and/or modified CDS sequence (wt) from DENV-3 Consensus__SSm-EdelTM-linker-ferritin
  source 1..1824: mol_type = other RNA
atgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcatccggcggcgacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctaa

SEQ ID NO: 1259 - RNA, 1821 nt, synthetic construct
  misc_feature 1..1821: note = derived and/or modified CDS sequence (wt) from DENV-3 Consensus__SStPA-WHbcAg-linker-EdelTM
  source 1..1821: mol_type = other RNA
atggatgcaatgaagagagggctctgctgtgtgctgctgctgtgtggagcagtcttcgttgacagcgtgaccggcatggacatagatccctataaagaatttggttcatcttatcagttgttgaattttcttcctttggacttctttcctgaccttaatgctttggtggacactgctactgccttgtatgaagaagagctaacaggtagggaacattgctctccgcaccatacagctattagacaagctttagtatgctgggatgaattaactaaattgatagcttggatgagctctaacataacttctgaacaagtaagaacaatcatagtaaatcatgtcaatgatacctggggacttaaggtgagacaaagtttatggtttcatttgtcatgtctcacttttggacaacatacagttcaagaatttttagtaagttttggagtatggatcagaactccagctccatatagacctcctaatgcacccattctctcgactcttccggaacatacagtcatttgcggcggcggcggctccggcggcggcggcatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcataa

SEQ ID NO: 1260 - RNA, 75 nt, synthetic construct
  misc_feature 1..75: note = derived and/or modified CDS sequence (opt1) from Homo sapiens__SigSeq(TPA)/SStPA
  source 1..75: mol_type = other RNA
atggacgccatgaagcgcggcctgtgctgcgtgctcctgctgtgcggggccgtcttcgtggacagcgtgaccggc

SEQ ID NO: 1261 - RNA, 492 nt, synthetic construct
  misc_feature 1..492: note = derived and/or modified CDS sequence (opt1) from Helicobacter pylori J99__Ferritin
  source 1..492: mol_type = other RNA
gacatcatcaagctcctgaacgagcaggtgaacaaggagatgcagtccagcaacctgtacatgtccatgagctcctggtgctacacccacagcctcgacggcgccgggctgttcctgttcgaccacgccgcggaggagtacgagcacgccaagaagctcatcatcttcctgaacgagaacaacgtccccgtgcagctgacctccatcagcgccccggagcacaagttcgagggcctcacgcagatcttccagaaggcctacgagcacgagcagcacatctccgagagcatcaacaacatcgtggaccacgccatcaagtccaaggaccacgcgaccttcaacttcctgcagtggtacgtcgccgagcagcacgaggaggaggtgctgttcaaggacatcctcgacaagatcgagctgatcgggaacgagaaccacggcctgtacctcgccgaccagtacgtgaaggggatcgccaagagccgcaagtcctga

SEQ ID NO: 1262 - RNA, 450 nt, synthetic construct
  misc_feature 1..450: note = derived and/or modified CDS sequence (opt1) from Woodchuck hepatitis virus__WHbcAg
  source 1..450: mol_type = other RNA
atggacatcgacccctacaaggagttcggcagctcctaccagctgctcaacttcctgcccctggacttcttccccgacctcaacgccctggtggacaccgccaccgcgctgtacgaggaggagctcacggggcgcgagcactgcagcccccaccacaccgccatccggcaggccctggtctgctgggacgagctgaccaagctcatcgcctggatgtccagcaacatcacctccgagcaggtgcgcacgatcatcgtgaaccacgtcaacgacacctggggcctgaaggtgcggcagagcctgtggttccacctctcctgcctgaccttcgggcagcacaccgtgcaggagttcctggtcagcttcggcgtgtggatccgcacgcccgccccgtaccggccgcccaacgcgccgatcctctccaccctgccggagcacaccgtgatctgc

SEQ ID NO: 1263 - RNA, 303 nt, synthetic construct
  misc_feature 1..303: note = derived and/or modified CDS sequence (opt1) from Japanese encephalitis virus__Cterm-JEV/JEV
  source 1..303: mol_type = other RNA
ggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcc

SEQ ID NO: 1264 - RNA, 15 nt, synthetic construct
  misc_feature 1..15: note = derived and/or modified CDS sequence (opt1) from Artificial__MKRKK
  source 1..15: mol_type = other RNA
atgaagcgcaagaag

SEQ ID NO: 1265 - skipped

SEQ ID NO: 1266 - RNA, 27 nt, synthetic construct
  misc_feature 1..27: note = derived and/or modified CDS sequence (opt1) from Artificial__Linker(G4SG4)
  source 1..27: mol_type = other RNA
ggcgggggcgggagcggcgggggcggc

SEQ ID NO: 1267 - RNA, 51 nt, synthetic construct
  misc_feature 1..51: note = derived and/or modified CDS sequence (opt1) from Foot-and-mouth disease virus__F2A/P2A
  source 1..51: mol_type = other RNA
aacttcgacctgctcaagctggccggcgacgtggagagcaaccccgggccg

SEQ ID NO: 1268 - RNA, 300 nt, synthetic construct
  misc_feature 1..300: note = derived and/or modified CDS sequence (opt1) from DENV-1 CYD23__C
  source 1..300: mol_type = other RNA
atgaacaaccagcgcaagaagaccgcccggccgagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaag

SEQ ID NO: 1269 - RNA, 342 nt, synthetic construct
  misc_feature 1..342: note = derived and/or modified CDS sequence (opt1) from DENV-1 CYD23__C-SSc
  source 1..342: mol_type = other RNA
atgaacaaccagcgcaagaagaccgcccggccgagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagagcgtgaccatgctgctcatgctgatgcccaccgccctggcc

SEQ ID NO: 1270 - RNA, 273 nt, synthetic construct
  misc_feature 1..273: note = derived and/or modified CDS sequence (opt1) from DENV-1 CYD23__pr
  source 1..273: mol_type = other RNA
ttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcgg

SEQ ID NO: 1271 - RNA, 225 nt, synthetic construct
  misc_feature 1..225: note = derived and/or modified CDS sequence (opt1) from DENV-1 CYD23__M
  source 1..225: mol_type = other RNA
tccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggcc

SEQ ID NO: 1272 - RNA, 498 nt, synthetic construct
  misc_feature 1..498: note = derived and/or modified CDS sequence (opt1) from DENV-1 CYD23__prM
  source 1..498: mol_type = other RNA
ttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggcc

SEQ ID NO: 1273 - RNA, 1485 nt, synthetic construct
  misc_feature 1..1485: note = derived and/or modified CDS sequence (opt1) from DENV-1 CYD23__E
  source 1..1485: mol_type = other RNA
atgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcc

SEQ ID NO: 1274 - RNA, 1983 nt, synthetic construct
  misc_feature 1..1983: note = derived and/or modified CDS sequence (opt1) from DENV-1 CYD23__prME
  source 1..1983: mol_type = other RNA
ttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcc

SEQ ID NO: 1275 - RNA, 2025 nt, synthetic construct
  misc_feature 1..2025: note = derived and/or modified CDS sequence (opt1) from DENV-1 CYD23__SSc-prME
  source 1..2025: mol_type = other RNA
agcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcc

SEQ ID NO: 1276 - RNA, 2325 nt, synthetic construct
  misc_feature 1..2325: note = derived and/or modified CDS sequence (opt1) from DENV-1 CYD23__C-prME
  source 1..2325: mol_type = other RNA
atgaacaaccagcgcaagaagaccgcccggccgagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcc

SEQ ID NO: 1277 - RNA, 45 nt, synthetic construct
  misc_feature 1..45: note = derived and/or modified CDS sequence (opt1) from DENV-1 CYD23__SSc
  source 1..45: mol_type = other RNA
atgagcgtgaccatgctgctcatgctgatgcccaccgccctggcc

SEQ ID NO: 1278 - RNA, 57 nt, synthetic construct
  misc_feature 1..57: note = derived and/or modified CDS sequence (opt1) from DENV-1 CYD23__SSopt
  source 1..57: mol_type = other RNA
atgaagcgcaagaagagcgtgaccatgctgctcatgctgatgcccaccgccctggcc

SEQ ID NO: 1279 - RNA, 57 nt, synthetic construct
  misc_feature 1..57: note = derived and/or modified CDS sequence (opt1) from DENV-1 CYD23__SSm
  source 1..57: mol_type = other RNA
atgacccagaaggggatcatcttcatcctcctgatgctggtgaccccctccatggcc

SEQ ID NO: 1280 - RNA, 1488 nt, synthetic construct
  misc_feature 1..1488: note = derived and/or modified CDS sequence (opt1) from DENV-1 CYD23__E
  source 1..1488: mol_type = other RNA
atgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1281 - RNA, 1182 nt, synthetic construct
  misc_feature 1..1182: note = derived and/or modified CDS sequence (opt1) from DENV-1 CYD23__EdelTM-variant (aa1-394)
  source 1..1182: mol_type = other RNA
atgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaag

SEQ ID NO: 1282 - RNA, 1275 nt, synthetic construct
  misc_feature 1..1275: note = derived and/or modified CDS sequence (opt1) from DENV-1 CYD23__EdelTM-variant (aa1-424)
  source 1..1275: mol_type = other RNA
atgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtcctga

SEQ ID NO: 1283 - RNA, 1266 nt, synthetic construct
  misc_feature 1..1266: note = derived and/or modified CDS sequence (opt1) from DENV-1 CYD23__EdelTM-variant (aa1-421)
  source 1..1266: mol_type = other RNA
atgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggactga

SEQ ID NO: 1284 - RNA, 2031 nt, synthetic construct
  misc_feature 1..2031: note = derived and/or modified CDS sequence (opt1) from DENV-1 CYD23__SSc-prME
  source 1..2031: mol_type = other RNA
atgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1285 - RNA, 2031 nt, synthetic construct
  misc_feature 1..2031: note = derived and/or modified CDS sequence (opt1) from DENV-1 CYD23__SSc-prME(F108S)
  source 1..2031: mol_type = other RNA
atgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgtccggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1286 - RNA, 2031 nt, synthetic construct
  misc_feature 1..2031: note = derived and/or modified CDS sequence (opt1) from DENV-1 CYD23__SSc-prMEdelstem_TM-JEV
  source 1..2031: mol_type = other RNA
atgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1287 - RNA, 2379 nt, synthetic construct
  misc_feature 1..2379: note = derived and/or modified CDS sequence (opt1) from DENV-1 CYD23__C-P2A-SSc-prME
  source 1..2379: mol_type = other RNA
atgaacaaccagcgcaagaagaccgcccggccgagcttcaacatgctgaagcgcgcccggaaccgcgtgtccaccgtcagccagctcgcgaagcggttctccaagggcctgctgagcgggcagggccccatgaagctcgtgatggccttcatcgccttcctgcgcttcctggccatcccgcccacggccgggatcctcgcgcggtggggctccttcaagaagaacggggccatcaaggtgctgcgcggcttcaagaaggagatcagcaacatgctgaacatcatgaaccggcgccggaagaacttcgacctgctcaagctggccggcgacgtggagagcaaccccgggccgagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcctcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1288 - RNA, 2043 nt, synthetic construct
  misc_feature 1..2043: note = derived and/or modified CDS sequence (opt1) from DENV-1 CYD23__SSopt-prME(F108S)
  source 1..2043: mol_type = other RNA
atgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgtccggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1289 - RNA, 2043 nt, synthetic construct
  misc_feature 1..2043: note = derived and/or modified CDS sequence (opt1) from DENV-1 CYD23__SSopt-prME(F96H)
  source 1..2043: mol_type = other RNA
atgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcacccacgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1290 - RNA, 2043 nt, synthetic construct
  misc_feature 1..2043: note = derived and/or modified CDS sequence (opt1) from DENV-1 CYD23__SSopt-prME(S186F)
  source 1..2043: mol_type = other RNA
atgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcttcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1291 - RNA, 2043 nt, synthetic construct
  misc_feature 1..2043: note = derived and/or modified CDS sequence (opt1) from DENV-1 CYD23__SSopt-prME(R188L)
  source 1..2043: mol_type = other RNA
atgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagccccctgacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaaggggtccagcatcggcaagatgttcgaggccaccgcccgcggggcccggcgcatggcgatcctgggcgacacggcctgggacttcgggtccatcggcggcgtgttcaccagcgtcgggaagctggtgcaccagatcttcggcaccgcctacggggtgctcttctccggcgtcagctggaccatgaagatcgggatcggcgtgctgctgacgtggctcggcctgaactcccgcagcacctccctgagcatgacctgcatcgccgtggggctcgtcaccctgtacctgggcgtgatggtgcaggcctga

SEQ ID NO: 1292 - RNA, 2043 nt, synthetic construct
  misc_feature 1..2043: note = derived and/or modified CDS sequence (opt1) from DENV-1 CYD23__SSopt-pr(D104A)MEdelstem_TM,(F108S)-JEV
  source 1..2043: mol_type = other RNA
atgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgccaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgagcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1293 - RNA, 2043 nt, synthetic construct
  misc_feature 1..2043: note = derived and/or modified CDS sequence (opt1) from DENV-1 CYD23__SSopt-prMEdelstem_TM,(H261N)-JEV
  source 1..2043: mol_type = other RNA
atgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagcccccgcacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgaacaccgccctgacgggggccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1294 - RNA, 2043 nt, synthetic construct
  misc_feature 1..2043: note = derived and/or modified CDS sequence (opt1) from DENV-1 CYD23__SSopt-prMEdelstem_TM,(R188L,A267T)-JEV
  source 1..2043: mol_type = other RNA
atgaagcgcaagaagagcgtgaccatgctgctcatgctgatgcccaccgccctggccttccacctcacgacccgcggcggggagccgcacatgatcgtctccaagcaggagcggggcaagagcctgctgttcaagacctccgcgggggtgaacatgtgcaccctcatcgccatggacctgggcgagctgtgcgaggacacgatgacctacaagtgcccccgcatcaccgaggccgagcccgacgacgtggactgctggtgcaacgccaccgacacgtgggtcacctacgggacctgcagccagaccggcgagcaccggcgcgacaagcggtccgtggccctcgcgccccacgtgggcctggggctggagacgcgcaccgagacctggatgagctccgagggcgcctggaagcagatccagcgggtcgagacctgggccctccgccacccggggttcacggtgatcgccctgttcctggcgcacgccatcggcaccagcatcacccagaaggggatcatcttcatcctcctgatgctggtgaccccctccatggccatgcggtgcgtcggcatcggcagccgcgacttcgtggaggggctctccggcgccacgtgggtggacgtcgtgctggagcacgggagctgcgtgaccaccatggccaaggacaagcccaccctggacatcgagctcctgaagacggaggtcaccaacccggcggtgctgcggaagctctgcatcgaggccaagatctccaacaccaccacggacagccgctgcccgacccagggcgaggccaccctggtggaggagcaggacgccaacttcgtctgccggcgcaccttcgtggaccggggctgggggaacggctgcgggctgttcggcaaggggtccctcatcacgtgcgccaagttcaagtgcgtgaccaagctggagggcaagatcgtccagtacgagaacctgaagtacagcgtgatcgtgaccgtccacaccggcgaccagcaccaggtggggaacgagtccacggagcacggcaccaccgcgaccatcaccccgcaggcccccacgaccgagatccagctcaccgactacggggccctgaccctggactgcagccccctgacgggcctcgacttcaacgagatggtcctgctgaccatgaaggagaagtcctggctcgtgcacaagcagtggttcctggacctgcccctcccctggaccagcggggccagcacctcccaggagacgtggaaccggcaggacctgctggtgaccttcaagaccgcccacgcgaagaagcaggaggtcgtggtgctcggcagccaggagggcgccatgcacaccgccctgacggggaccaccgagatccagacctccggcaccacgaccatcttcgccgggcacctgaagtgccgcctcaagatggacaagctgaccctgaagggcatgagctacgtcatgtgcaccgggtccttcaagctggagaaggaggtggcggagacgcagcacggcaccgtgctcgtccagatcaagtacgagggcaccgacgccccctgcaagatccccttcagcacccaggacgagaagggggtgacgcagaacggccggctgatcaccgccaaccccatcgtgaccgacaaggagaagcccgtcaacatcgaggccgagccgcccttcggggagtcctacatcgtgatcggcgcgggcgagaaggccctgaagctcagctggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1295 - RNA, 300 nt, synthetic construct
  misc_feature 1..300: note = derived and/or modified CDS sequence (opt1) from DENV-2 CYD2-T__C
  source 1..300: mol_type = other RNA
atgaacaaccagcgcaagaaggccaagaacaccccgttcaacatgctgaagcgggagcgcaaccgggtgagcaccgtccagcagctcacgaagcgcttctccctgggcatgctgcaggggcggggccccctcaagctgttcatggccctggtggcgttcctccgcttcctgaccatcccgcccaccgccgggatcctgaagcggtggggcaccatcaagaagagcaaggccatcaacgtgctccgcgggttccggaaggagatcggccgcatgctgaacatcctgaaccggcgccggcgc

SEQ ID NO: 1296 - RNA, 342 nt, synthetic construct
  misc_feature 1..342: note = derived and/or modified CDS sequence (opt1) from DENV-2 CYD2-T__C-SSc
  source 1..342: mol_type = other RNA
atgaacaaccagcgcaagaaggccaagaacaccccgttcaacatgctgaagcgggagcgcaaccgggtgagcaccgtccagcagctcacgaagcgcttctccctgggcatgctgcaggggcggggccccctcaagctgttcatggccctggtggcgttcctccgcttcctgaccatcccgcccaccgccgggatcctgaagcggtggggcaccatcaagaagagcaaggccatcaacgtgctccgcgggttccggaaggagatcggccgcatgctgaacatcctgaaccggcgccggcgcagcgccggcatgatcatcatgctgatccccaccgtgatggcc

SEQ ID NO: 1297 - RNA, 273 nt, synthetic construct
  misc_feature 1..273: note = derived and/or modified CDS sequence (opt1) from DENV-2 CYD2-T__pr
  source 1..273: mol_type = other RNA
ttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcgg

SEQ ID NO: 1298 - RNA, 225 nt, synthetic construct
  misc_feature 1..225: note = derived and/or modified CDS sequence (opt1) from DENV-2 CYD2-T__M
  source 1..225: mol_type = other RNA
tccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgacc

SEQ ID NO: 1299 - RNA, 498 nt, synthetic construct
  misc_feature 1..498: note = derived and/or modified CDS sequence (opt1) from DENV-2 CYD2-T__prM
  source 1..498: mol_type = other RNA
ttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgacc

SEQ ID NO: 1300 - RNA, 1485 nt, synthetic construct
  misc_feature 1..1485: note = derived and/or modified CDS sequence (opt1) from DENV-2 CYD2-T__E
  source 1..1485: mol_type = other RNA
atgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcc

SEQ ID NO: 1301 - RNA, 1983 nt, synthetic construct
  misc_feature 1..1983: note = derived and/or modified CDS sequence (opt1) from DENV-2 CYD2-T__prME
  source 1..1983: mol_type = other RNA
ttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcc

SEQ ID NO: 1302 - RNA, 2025 nt, synthetic construct
  misc_feature 1..2025: note = derived and/or modified CDS sequence (opt1) from DENV-2 CYD2-T__SSc-prME
  source 1..2025: mol_type = other RNA
agcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcc

SEQ ID NO: 1303 - RNA, 2325 nt, synthetic construct
  misc_feature 1..2325: note = derived and/or modified CDS sequence (opt1) from DENV-2 CYD2-T__C-prME
  source 1..2325: mol_type = other RNA
atgaacaaccagcgcaagaaggccaagaacaccccgttcaacatgctgaagcgggagcgcaaccgggtgagcaccgtccagcagctcacgaagcgcttctccctgggcatgctgcaggggcggggccccctcaagctgttcatggccctggtggcgttcctccgcttcctgaccatcccgcccaccgccgggatcctgaagcggtggggcaccatcaagaagagcaaggccatcaacgtgctccgcgggttccggaaggagatcggccgcatgctgaacatcctgaaccggcgccggcgcagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcc

SEQ ID NO: 1304 - RNA, 45 nt, synthetic construct
  misc_feature 1..45: note = derived and/or modified CDS sequence (opt1) from DENV-2 CYD2-T__SSc
  source 1..45: mol_type = other RNA
atgagcgccggcatgatcatcatgctgatccccaccgtgatggcc

SEQ ID NO: 1305 - RNA, 60 nt, synthetic construct
  misc_feature 1..60: note = derived and/or modified CDS sequence (opt1) from DENV-2 CYD2-T__SSopt
  source 1..60: mol_type = other RNA
atgaagcgcaagaagatgagcgccggcatgatcatcatgctgatccccaccgtgatggcc

SEQ ID NO: 1306 - RNA, 57 nt, synthetic construct
  misc_feature 1..57: note = derived and/or modified CDS sequence (opt1) from DENV-2 CYD2-T__SSm
  source 1..57: mol_type = other RNA
atgttccagcgggccctcatcttcatcctgctgaccgccgtgacgcccagcatgacc

SEQ ID NO: 1307 - RNA, 1488 nt, synthetic construct
  misc_feature 1..1488: note = derived and/or modified CDS sequence (opt1) from DENV-2 CYD2-T__E
  source 1..1488: mol_type = other RNA
atgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1308 - RNA, 1182 nt, synthetic construct
  misc_feature 1..1182: note = derived and/or modified CDS sequence (opt1) from DENV-2 CYD2-T__EdelTM-variant (aa1-394)
  source 1..1182: mol_type = other RNA
atgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaag

SEQ ID NO: 1309 - RNA, 1272 nt, synthetic construct
  misc_feature 1..1272: note = derived and/or modified CDS sequence (opt1) from DENV-2 CYD2-T__EdelTM-variant (aa1-424)
  source 1..1272: mol_type = other RNA
atgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagc

SEQ ID NO: 1310 - RNA, 1266 nt, synthetic construct
  misc_feature 1..1266: note = derived and/or modified CDS sequence (opt1) from DENV-2 CYD2-T__EdelTM-variant (aa1-421)
  source 1..1266: mol_type = other RNA
atgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggactga

SEQ ID NO: 1311 - RNA, 2031 nt, synthetic construct
  misc_feature 1..2031: note = derived and/or modified CDS sequence (opt1) from DENV-2 CYD2-T__SSc-prME
  source 1..2031: mol_type = other RNA
atgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1312 - RNA, 2031 nt, synthetic construct
  misc_feature 1..2031: note = derived and/or modified CDS sequence (opt1) from DENV-2 CYD2-T__SSc-prME(F108S)
  source 1..2031: mol_type = other RNA
atgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctctccgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1313 - RNA, 2031 nt, synthetic construct
  misc_feature 1..2031: note = derived and/or modified CDS sequence (opt1) from DENV-2 CYD2-T__SSc-prMEdelstem_TM-JEV
  source 1..2031: mol_type = other RNA
atgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1314 - RNA, 1332 nt, synthetic construct
  misc_feature 1..1332: note = derived and/or modified CDS sequence (opt1) from DENV-2 CYD2-T__SSm-EdelTM
  source 1..1332: mol_type = other RNA
atgttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagctga

SEQ ID NO: 1315 - RNA, 2379 nt, synthetic construct
  misc_feature 1..2379: note = derived and/or modified CDS sequence (opt1) from DENV-2 CYD2-T__C-P2A-SSc-prME
  source 1..2379: mol_type = other RNA
atgaacaaccagcgcaagaaggccaagaacaccccgttcaacatgctgaagcgggagcgcaaccgggtgagcaccgtccagcagctcacgaagcgcttctccctgggcatgctgcaggggcggggccccctcaagctgttcatggccctggtggcgttcctccgcttcctgaccatcccgcccaccgccgggatcctgaagcggtggggcaccatcaagaagagcaaggccatcaacgtgctccgcgggttccggaaggagatcggccgcatgctgaacatcctgaaccggcgccggcgcaacttcgacctgctcaagctggccggcgacgtggagagcaaccccgggccgagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1316 - RNA, 2043 nt, synthetic construct
  misc_feature 1..2043: note = derived and/or modified CDS sequence (opt1) from DENV-2 CYD2-T__SSopt-prME(F108S)
  source 1..2043: mol_type = other RNA
atgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctctccgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1317 - RNA, 2043 nt, synthetic construct
  misc_feature 1..2043: note = derived and/or modified CDS sequence (opt1) from DENV-2 CYD2-T__SSopt-prME(M96H)
  source 1..2043: mol_type = other RNA
atgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactcccacgtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1318 - RNA, 2043 nt, synthetic construct
  misc_feature 1..2043: note = derived and/or modified CDS sequence (opt1) from DENV-2 CYD2-T__SSopt-prME(S186F)
  source 1..2043: mol_type = other RNA
atgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgcttcccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1319 - RNA, 2043 nt, synthetic construct
  misc_feature 1..2043: note = derived and/or modified CDS sequence (opt1) from DENV-2 CYD2-T__SSopt-prME(R188L)
  source 1..2043: mol_type = other RNA
atgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgctgacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagctccatcgggcagatgttcgagaccaccatgcggggcgccaagcgcatggcgatcctgggcgacaccgcctgggacttcgggagcctgggcggggtgttcacgtccatcggcaaggccctgcaccaggtgttcggggccatctacggcgccgcgttcagcggcgtctcctggaccatgaagatcctcatcggggtgatcatcacctggatcggcatgaacagccggtccaccagcctgtccgtgacgctggtcctcgtggggatcgtgaccctgtacctgggcgtcatggtgcaggcctga

SEQ ID NO: 1320 - RNA, 2043 nt, synthetic construct
  misc_feature 1..2043: note = derived and/or modified CDS sequence (opt1) from DENV-2 CYD2-T__SSopt-pr(D104A)MEdelstem_TM,(F108S)-JEV
  source 1..2043: mol_type = other RNA
atgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgccaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcagcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1321 - RNA, 2043 nt, synthetic construct
  misc_feature 1..2043: note = derived and/or modified CDS sequence (opt1) from DENV-2 CYD2-T__SSopt-prMEdelstem_TM,(H261N)-JEV
  source 1..2043: mol_type = other RNA
atgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgcggacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgaacacggcgctgaccggcgccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1322 - RNA, 2043 nt, synthetic construct
  misc_feature 1..2043: note = derived and/or modified CDS sequence (opt1) from DENV-2 CYD2-T__SSopt-prMEdelstem_TM,(R188L,A267T)-JEV
  source 1..2043: mol_type = other RNA
atgaagcgcaagaagagcgccggcatgatcatcatgctgatccccaccgtgatggccttccacctcaccacgcgcaacggggagccgcacatgatcgtctcccggcaggagaagggcaagagcctgctgttcaagaccgaggacggggtgaacatgtgcaccctcatggcgatggacctgggcgagctgtgcgaggacaccatcacgtacaagtgccccctcctgcgccagaacgagcccgaggacatcgactgctggtgcaactccaccagcacctgggtgacctacgggacgtgcaccaccatgggcgagcaccggcgcgagaagcggtccgtcgccctggtgccccacgtgggcatggggctcgagacccgcacggagacctggatgagctccgagggcgcctggaagcacgtccagcggatcgagacctggatcctgcgccacccggggttcaccatgatggccgccatcctggcgtacacgatcggcaccacccacttccagcgggccctcatcttcatcctgctgaccgccgtgacgcccagcatgaccatgcgctgcatcgggatgtccaaccgggacttcgtggagggcgtcagcggcgggtcctgggtggacatcgtgctcgagcacggcagctgcgtcaccaccatggccaagaacaagcccacgctggacttcgagctgatcaagaccgaggcgaagcagcccgccaccctccgcaagtactgcatcgaggccaagctgaccaacacgaccaccgagtcccggtgcccgacccagggggagcccagcctgaacgaggagcaggacaagcgcttcgtgtgcaagcactccatggtggaccggggctggggcaacgggtgcggcctcttcgggaagggcgggatcgtcacgtgcgccatgttccgctgcaagaagaacatggagggcaaggtggtgcagcccgagaacctggagtacaccatcgtcatcaccccgcacagcggcgaggagcacgccgtggggaacgacaccggcaagcacgggaaggagatcaagatcacgccccagtccagcatcaccgaggcggagctgaccggctacgggaccgtgaccatggagtgctccccgctgacgggcctcgacttcaacgagatggtcctgctgcagatggagaacaaggcctggctcgtgcaccgccagtggttcctggacctgcccctcccctggctgccgggcgccgacacccaggggagcaactggatccagaaggagaccctggtgaccttcaagaacccccacgccaagaagcaggacgtcgtggtcctcggcagccaggagggggccatgcacacggcgctgaccggcaccaccgagatccagatgtccagcgggaacctgctcttcaccggccacctgaagtgccggctgcgcatggacaagctccagctgaagggcatgtcctacagcatgtgcacggggaagttcaaggtggtgaaggagatcgccgagacccagcacggcaccatcgtcatccgggtgcagtacgagggggacggctccccctgcaagatccccttcgagatcatggacctggagaagcgccacgtgctcggccgcctgatcaccgtcaaccccatcgtgacggagaaggacagccccgtgaacatcgaggccgagccgcccttcggggactcctacatcatcatcggcgtcgagccggggcagctgaagctcaactggttcaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1323 - RNA, 297 nt, synthetic construct
  misc_feature 1..297: note = derived and/or modified CDS sequence (opt1) from DENV-4 Consensus__C
  source 1..297: mol_type = other RNA
atgaaccagcgcaagaaggtggtccggcccccgttcaacatgctgaagcgcgagcggaaccgcgtgagcaccccgcagggcctcgtgaagcggttctccaccgggctgttcagcggcaaggggcccctgcgcatggtcctcgccttcatcacgttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgc

SEQ ID NO: 1324 - RNA, 339 nt, synthetic construct
  misc_feature 1..339: note = derived and/or modified CDS sequence (opt1) from DENV-4 Consensus__C-SSc
  source 1..339: mol_type = other RNA
atgaaccagcgcaagaaggtggtccggcccccgttcaacatgctgaagcgcgagcggaaccgcgtgagcaccccgcagggcctcgtgaagcggttctccaccgggctgttcagcggcaaggggcccctgcgcatggtcctcgccttcatcacgttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcagcaccatcaccctgctctgcctgatccccacggtgatggcc

SEQ ID NO: 1325 - RNA, 273 nt, synthetic construct
  misc_feature 1..273: note = derived and/or modified CDS sequence (opt1) from DENV-4 Consensus__pr
  source 1..273: mol_type = other RNA
ttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgc

SEQ ID NO: 1326 - RNA, 225 nt, synthetic construct
  misc_feature 1..225: note = derived and/or modified CDS sequence (opt1) from DENV-4 Consensus__M
  source 1..225: mol_type = other RNA
agcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggc

SEQ ID NO: 1327 - RNA, 498 nt, synthetic construct
  misc_feature 1..498: note = derived and/or modified CDS sequence (opt1) from DENV-4 Consensus__prM
  source 1..498: mol_type = other RNA
ttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggc

SEQ ID NO: 1328 - RNA, 1485 nt, synthetic construct
  misc_feature 1..1485: note = derived and/or modified CDS sequence (opt1) from DENV-4 Consensus__E
  source 1..1485: mol_type = other RNA
atgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcc

SEQ ID NO: 1329 - RNA, 1983 nt, synthetic construct
  misc_feature 1..1983: note = derived and/or modified CDS sequence (opt1) from DENV-4 Consensus__prME
  source 1..1983: mol_type = other RNA
ttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcc

SEQ ID NO: 1330 - RNA, 2025 nt, synthetic construct
  misc_feature 1..2025: note = derived and/or modified CDS sequence (opt1) from DENV-4 Consensus__SSc-prME
  source 1..2025: mol_type = other RNA
agcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcc

SEQ ID NO: 1331 - RNA, 2322 nt, synthetic construct
  misc_feature 1..2322: note = derived and/or modified CDS sequence (opt1) from DENV-4 Consensus__C-prME
  source 1..2322: mol_type = other RNA
atgaaccagcgcaagaaggtggtccggcccccgttcaacatgctgaagcgcgagcggaaccgcgtgagcaccccgcagggcctcgtgaagcggttctccaccgggctgttcagcggcaaggggcccctgcgcatggtcctcgccttcatcacgttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcc

SEQ ID NO: 1332 - RNA, 45 nt, synthetic construct
  misc_feature 1..45: note = derived and/or modified CDS sequence (opt1) from DENV-4 Consensus__SSc
  source 1..45: mol_type = other RNA
atgagcaccatcaccctgctctgcctgatccccacggtgatggcc

SEQ ID NO: 1333 - RNA, 57 nt, synthetic construct
  misc_feature 1..57: note = derived and/or modified CDS sequence (opt1) from DENV-4 Consensus__SSopt
  source 1..57: mol_type = other RNA
atgaagcgcaagaagagcaccatcaccctgctctgcctgatccccacggtgatggcc

SEQ ID NO: 1334 - RNA, 57 nt, synthetic construct
  misc_feature 1..57: note = derived and/or modified CDS sequence (opt1) from DENV-4 Consensus__SSm
  source 1..57: mol_type = other RNA
atgatccagcgcacggtcttcttcgtgctgatgatgctggtggccccctcctacggc

SEQ ID NO: 1335 - RNA, 1488 nt, synthetic construct
  misc_feature 1..1488: note = derived and/or modified CDS sequence (opt1) from DENV-4 Consensus__E
  source 1..1488: mol_type = other RNA
atgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1336 - RNA, 1182 nt, synthetic construct
  misc_feature 1..1182: note = derived and/or modified CDS sequence (opt1) from DENV-4 Consensus__EdelTM-variant (aa1-394)
  source 1..1182: mol_type = other RNA
atgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaag

SEQ ID NO: 1337 - RNA, 1272 nt, synthetic construct
  misc_feature 1..1272: note = derived and/or modified CDS sequence (opt1) from DENV-4 Consensus__EdelTM-variant (aa1-424)
  source 1..1272: mol_type = other RNA
atgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtcc

SEQ ID NO: 1338 - RNA, 1266 nt, synthetic construct
  misc_feature 1..1266: note = derived and/or modified CDS sequence (opt1) from DENV-4 Consensus__EdelTM-variant (aa1-421)
  source 1..1266: mol_type = other RNA
atgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggactga

SEQ ID NO: 1339 - RNA, 2031 nt, synthetic construct
  misc_feature 1..2031: note = derived and/or modified CDS sequence (opt1) from DENV-4 Consensus__SSc-prME
  source 1..2031: mol_type = other RNA
atgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1340 - RNA, 2031 nt, synthetic construct
  misc_feature 1..2031: note = derived and/or modified CDS sequence (opt1) from DENV-4 Consensus__SSc-prME(F108S)
  source 1..2031: mol_type = other RNA
atgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgtccgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1341 - RNA, 2031 nt, synthetic construct
  misc_feature 1..2031: note = derived and/or modified CDS sequence (opt1) from DENV-4 Consensus__SSc-prMEdelstem_TM-JEV
  source 1..2031: mol_type = other RNA
atgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1342 - RNA, 1332 nt, synthetic construct
  misc_feature 1..1332: note = derived and/or modified CDS sequence (opt1) from DENV-4 Consensus__SSm-EdelTM
  source 1..1332: mol_type = other RNA
atgatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtcctga

SEQ ID NO: 1343 - RNA, 2376 nt, synthetic construct
  misc_feature 1..2376: note = derived and/or modified CDS sequence (opt1) from DENV-4 Consensus__C-P2A-SSc-prME
  source 1..2376: mol_type = other RNA
atgaaccagcgcaagaaggtggtccggcccccgttcaacatgctgaagcgcgagcggaaccgcgtgagcaccccgcagggcctcgtgaagcggttctccaccgggctgttcagcggcaaggggcccctgcgcatggtcctcgccttcatcacgttcctgcgggtgctgtccatcccgcccaccgccggcatcctcaagcgctgggggcagctgaagaagaacaaggcgatcaagatcctgatcggcttccggaaggagatcggccgcatgctcaacatcctgaacgggcggaagcgcaacttcgacctgctcaagctggccggcgacgtggagagcaaccccgggccgagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1344 - RNA, 2043 nt, synthetic construct
  misc_feature 1..2043: note = derived and/or modified CDS sequence (opt1) from DENV-4 Consensus__SSopt-prME(F108S)
  source 1..2043: mol_type = other RNA
atgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgtccgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1345 - RNA, 2043 nt, synthetic construct
  misc_feature 1..2043: note = derived and/or modified CDS sequence (opt1) from DENV-4 Consensus__SSopt-prME(V96H)
  source 1..2043: mol_type = other RNA
atgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgaccacgtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1346 - RNA, 2043 nt, synthetic construct
  misc_feature 1..2043: note = derived and/or modified CDS sequence (opt1) from DENV-4 Consensus__SSopt-prME(E186F)
  source 1..2043: mol_type = other RNA
atgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcttcccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1347 - RNA, 2043 nt, synthetic construct
  misc_feature 1..2043: note = derived and/or modified CDS sequence (opt1) from DENV-4 Consensus__SSopt-prME(R188L)
  source 1..2043: mol_type = other RNA
atgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagcccctgagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaaggggagctccatcggcaagatgttcgagagcacctaccgcggggccaagcggatggccatcctgggcgagacggcgtgggacttcgggtccgtgggcggcctcttcaccagcctggggaaggccgtccaccaggtgttcggctccgtgtacaccaccatgttcgggggcgtcagctggatgatccgcatcctgatcgggttcctggtgctctggatcggcacgaactcccggaacaccagcatggccatgacctgcatcgccgtgggcgggatcaccctgttcctgggcttcacggtccaggcctga

SEQ ID NO: 1348 - RNA, 2043 nt, synthetic construct
  misc_feature 1..2043: note = derived and/or modified CDS sequence (opt1) from DENV-4 Consensus__SSopt-pr(D104A)MEdelstem_TM,(F108S)-JEV
  source 1..2043: mol_type = other RNA
atgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggccaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgagcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1349 - RNA, 2043 nt, synthetic construct
  misc_feature 1..2043: note = derived and/or modified CDS sequence (opt1) from DENV-4 Consensus__SSopt-prMEdelstem_TM,(H261N)-JEV
  source 1..2043: mol_type = other RNA
atgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagccccggagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgaacagcgccctggccggcgcgaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1350 - RNA, 2043 nt, synthetic construct
  misc_feature 1..2043: note = derived and/or modified CDS sequence (opt1) from DENV-4 Consensus__SSopt-prMEdelstem_TM,(R188L,A267T)-JEV
  source 1..2043: mol_type = other RNA
atgaagcgcaagaagagcaccatcaccctgctctgcctgatccccacggtgatggccttccacctgtccacccgcgacggcgagccgctcatgatcgtcgccaagcacgagcgggggcgccccctgctgttcaagaccaccgagggcatcaacaagtgcacgctcatcgcgatggacctgggggagatgtgcgaggacaccgtgacctacaagtgccccctgctcgtgaacaccgagcccgaggacatcgactgctggtgcaacctgacgagcacctgggtcatgtacggcacctgcacccagtccggggagcggcgccgggagaagcgcagcgtggccctgacgccgcactccggcatgggcctcgagacccgggccgagacctggatgagctccgagggggcctggaagcacgcccagcgcgtggagagctggatcctgcggaaccccggcttcgcgctgctcgccgggttcatggcctacatgatcggccagaccgggatccagcgcacggtcttcttcgtgctgatgatgctggtggccccctcctacggcatgcggtgcgtcggcgtggggaaccgcgacttcgtggagggcgtcagcgggggcgcgtgggtggacctcgtgctggagcacggcgggtgcgtcaccaccatggcccagggcaagcccaccctggacttcgagctcacgaagaccaccgccaaggaggtggccctgctgcggacctactgcatcgaggcctccatcagcaacatcacgaccgcgacccgctgcccgacccagggggagccctacctcaaggaggagcaggaccagcagtacatctgccggcgcgacgtggtcgaccggggctgggggaacggctgcggcctgttcgggaagggcggggtggtgacgtgcgccaagttctcctgcagcggcaagatcaccgggaacctggtccagatcgagaacctcgagtacaccgtggtggtcaccgtgcacaacggcgacacgcacgccgtcggcaacgacacctccaaccacggggtgaccgccaccatcacgccccgcagcccctccgtggaggtcaagctgccggactacggcgagctgaccctcgactgcgagcccctgagcgggatcgacttcaacgagatgatcctgatgaagatgaagaagaagacctggctggtgcacaagcagtggttcctcgacctgcccctgccctggaccgccggcgcggacacctccgaggtgcactggaactacaaggagcgcatggtcacgttcaaggtgccgcacgccaagcggcaggacgtgaccgtcctcgggagccaggagggcgccatgcacagcgccctggccggcaccaccgaggtggactccggggacggcaaccacatgttcgccgggcacctgaagtgcaaggtgcgcatggagaagctccgcatcaagggcatgagctacaccatgtgctccggcaagttcagcatcgacaaggagatggccgagacgcagcacgggaccaccgtcgtgaaggtgaagtacgagggcgccggggccccctgcaaggtccccatcgagatccgggacgtgaacaaggagaaggtggtcggccgcgtgatctccagcaccccgctggcggagaacacgaactccgtgaccaacatcgagctggagccgcccttcggggacagctacatcgtcatcggcgtgggcaactccgccctcaccctgcactggttccggaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1351 - RNA, 300 nt, synthetic construct
  misc_feature 1..300: note = derived and/or modified CDS sequence (opt1) from DENV-3 Consensus__C
  source 1..300: mol_type = other RNA
atgaacaaccagcgcaagaagaccggcaagccgagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagagcggcgccatcaaggtcctgaaggggttcaagaaggagatctccaacatgctgagcatcatcaacaagcggaagaag

SEQ ID NO: 1352 - RNA, 342 nt, synthetic construct
  misc_feature 1..342: note = derived and/or modified CDS sequence (opt1) from DENV-3 Consensus__C-SSc
  source 1..342: mol_type = other RNA
atgaacaaccagcgcaagaagaccggcaagccgagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagagcggcgccatcaaggtcctgaaggggttcaagaaggagatctccaacatgctgagcatcatcaacaagcggaagaagaccagcctgtgcctcatgatgatcctgcccgccgccctggcg

SEQ ID NO: 1353 - RNA, 273 nt, synthetic construct
  misc_feature 1..273: note = derived and/or modified CDS sequence (opt1) from DENV-3 Consensus__pr
  source 1..273: mol_type = other RNA
ttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcgg

SEQ ID NO: 1354 - RNA, 225 nt, synthetic construct
  misc_feature 1..225: note = derived and/or modified CDS sequence (opt1) from DENV-3 Consensus__M
  source 1..225: mol_type = other RNA
tccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgacc

SEQ ID NO: 1355 - RNA, 498 nt, synthetic construct
  misc_feature 1..498: note = derived and/or modified CDS sequence (opt1) from DENV-3 Consensus__prM
  source 1..498: mol_type = other RNA
ttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgacc

SEQ ID NO: 1356 - RNA, 1479 nt, synthetic construct
  misc_feature 1..1479: note = derived and/or modified CDS sequence (opt1) from DENV-3 Consensus__E
  source 1..1479: mol_type = other RNA
atgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcc

SEQ ID NO: 1357 - RNA, 1977 nt, synthetic construct
  misc_feature 1..1977: note = derived and/or modified CDS sequence (opt1) from DENV-3 Consensus__prME
  source 1..1977: mol_type = other RNA
ttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcc

SEQ ID NO: 1358 - RNA, 2019 nt, synthetic construct
  misc_feature 1..2019: note = derived and/or modified CDS sequence (opt1) from DENV-3 Consensus__SSc-prME
  source 1..2019: mol_type = other RNA
accagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcc

SEQ ID NO: 1359 - RNA, 1056 nt, synthetic construct
  misc_feature 1..1056: note = derived and/or modified CDS sequence (opt1) from DENV-3 Consensus__NS1
  source 1..1056: mol_type = other RNA
gacatgggctgcgtgatcaactggaaggggaaggagctgaagtgcggcagcgggatcttcgtcaccaacgaggtgcacacctggacggagcagtacaagttccaggccgactcccccaagcgcctcgccaccgcgatcgccggcgcctgggagaacggggtgtgcggcatccggagcaccacccgcatggagaacctgctgtggaagcagatcgccaacgagctcaactacatcctgtgggagaacaacatcaagctgacggtcgtggtgggcgacatcatcggggtcctcgagcagggcaagcggaccctgaccccgcagcccatggagctgaagtactcctggaagacctgggggaaggccaagatcgtgacggcggagacccagaacagctccttcatcatcgacggccccaacacccccgagtgcccgagcgtgtcccgcgcctggaacgtctgggaggtggaggactacgggttcggcgtgttcaccacgaacatctggctcaagctgcgggaggtctacacccagctgtgcgaccaccgcctcatgagcgccgccgtgaaggacgagcgggcggtgcacgccgacatgggctactggatcgagtcccagaagaacgggagctggaagctggagaaggcctccctgatcgaggtcaagacctgcacctggcccaagagccacacgctctggtccaacggcgtgctggagagcgacatgatcatccccaagtccctggccgggcccatcagccagcacaaccaccgcccgggctaccacacccagaccgccggcccctggcacctcgggaagctggagctggacttcaactactgcgagggcaccacggtggtcatcaccgagaactgcgggacccggggcccctccctccgcaccacgaccgtgagcgggaagctgatccacgagtggtgctgccggtcctgcaccctgcccccgctccgctacatgggcgaggacggctgctggtacgggatggagatccggcccatcagcgagaaggaggagaacatggtgaagagcctggtctccgcg

SEQ ID NO: 1360 - RNA, 1857 nt, synthetic construct
  misc_feature 1..1857: note = derived and/or modified CDS sequence (opt1) from DENV-3 Consensus__NS3
  source 1..1857: mol_type = other RNA
agcggcgtgctgtgggacgtcccctccccgcccgagacccagaaggccgagctcgaggagggggtgtaccgcatcaagcagcagggcatcttcgggaagacccaggtgggcgtcggggtgcagaaggagggcgtgttccacacgatgtggcacgtcacccggggcgccgtgctgacctacaacgggaagcgcctggagcccaactgggcgagcgtgaagaaggacctcatctcctacggcgggggctggcggctgagcgcccagtggcagaagggggaggaggtccaggtgatcgccgtggagcccggcaagaacccgaagaacttccagaccatgcccggcacgttccagaccaccaccggggagatcggcgccatcgccctggacttcaagcccgggacgtccggcagccccatcatcaaccgcgagggcaaggtcgtggggctctacggcaacggggtggtcaccaagaacggcgggtacgtgtccggcatcgcgcagaccaacgccgagccggacggccccacccccgagctggaggaggagatgttcaagaagcggaacctgacgatcatggacctccaccccgggagcggcaagacccgcaagtacctgccggccatcgtgcgggaggccatcaagcgccggctgcgcaccctcatcctggcgcccacccgggtcgtggccgccgagatggaggaggccctgaaggggctccccatccgctaccagacgaccgccaccaagtccgagcacaccggccgggagatcgtggacctgatgtgccacgcgacgttcaccatgcgcctgctcagccccgtccgggtgccgaactacaacctgatcatcatggacgaggcccacttcaccgaccccgcctccatcgccgcccgcgggtacatcagcacccgggtgggcatgggcgaggcggccgccatcttcatgacggccaccccgcccgggaccgccgacgcgttcccgcagtccaacgcccccatccaggacgaggagcgcgacatccccgagcggagctggaactccggcaacgagtggatcaccgacttcgccgggaagacggtctggttcgtgcccagcatcaaggccggcaacgacatcgccaactgcctgcgcaagaacgggaagaaggtcatccagctctcccggaagaccttcgacaccgagtaccagaagaccaagctgaacgactgggacttcgtggtgacgaccgacatcagcgagatgggcgcgaacttcaaggccgaccgcgtcatcgacccgcgccggtgcctgaagcccgtgatcctcaccgacggccccgagcgcgtgatcctggccgggcccatgccggtcaccgccgcgtccgccgcccagcggcgcggccgggtggggcgcaacccccagaaggagaacgaccagtacatcttcacgggccagcccctgaacaacgacgaggaccacgcccactggaccgaggccaagatgctcctggacaacatcaacaccccggagggcatcatccccgcgctgttcgagcccgagcgggagaagagcgccgccatcgacggggagtaccgcctcaagggcgagagccggaagaccttcgtggagctgatgcgccggggcgacctgcccgtctggctcgcccacaaggtggcctccgaggggatcaagtacaccgaccgcaagtggtgcttcgacgggcagcggaacaaccagatcctggaggagaacatggacgtggagatctggacgaaggagggcgagaagaagaagctgcgcccgcggtggctcgacgcgcgcacctacagcgaccccctggccctgaaggagttcaaggagttcgccgccggccggaag

SEQ ID NO: 1361 - RNA, 2319 nt, synthetic construct
  misc_feature 1..2319: note = derived and/or modified CDS sequence (opt1) from DENV-3 Consensus__C-prME
  source 1..2319: mol_type = other RNA
atgaacaaccagcgcaagaagaccggcaagccgagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagagcggcgccatcaaggtcctgaaggggttcaagaaggagatctccaacatgctgagcatcatcaacaagcggaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcc

SEQ ID NO: 1362 - RNA, 45 nt, synthetic construct
  misc_feature 1..45: note = derived and/or modified CDS sequence (opt1) from DENV-3 Consensus__SSc
  source 1..45: mol_type = other RNA
atgaccagcctgtgcctcatgatgatcctgcccgccgccctggcg

SEQ ID NO: 1363 - RNA, 57 nt, synthetic construct
  misc_feature 1..57: note = derived and/or modified CDS sequence (opt1) from DENV-3 Consensus__SSopt
  source 1..57: mol_type = other RNA
atgaagcgcaagaagaccagcctgtgcctcatgatgatcctgcccgccgccctggcg

SEQ ID NO: 1364 - RNA, 57 nt, synthetic construct
  misc_feature 1..57: note = derived and/or modified CDS sequence (opt1) from DENV-3 Consensus__SSm
  source 1..57: mol_type = other RNA
atgacccagaaggtggtgatcttcatcctgctgatgctcgtcacgcccagcatgacc

SEQ ID NO: 1365 - RNA, 1482 nt, synthetic construct
  misc_feature 1..1482: note = derived and/or modified CDS sequence (opt1) from DENV-3 Consensus__E
  source 1..1482: mol_type = other RNA
atgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1366 - RNA, 1176 nt, synthetic construct
  misc_feature 1..1176: note = derived and/or modified CDS sequence (opt1) from DENV-3 Consensus__EdelTM-variant (aa1-392)
  source 1..1176: mol_type = other RNA
atgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaag

SEQ ID NO: 1367 - RNA, 1269 nt, synthetic construct
  misc_feature 1..1269: note = derived and/or modified CDS sequence (opt1) from DENV-3 Consensus__EdelTM-variant (aa1-422)
  source 1..1269: mol_type = other RNA
atgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctga

SEQ ID NO: 1368 - RNA, 1260 nt, synthetic construct
  misc_feature 1..1260: note = derived and/or modified CDS sequence (opt1) from DENV-3 Consensus__EdelTM-variant (aa1-419)
  source 1..1260: mol_type = other RNA
atgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggactga

SEQ ID NO: 1369 - RNA, 1155 nt, synthetic construct
  misc_feature 1..1155: note = derived and/or modified CDS sequence (opt1) from DENV-3 Consensus__Edelaa101-107
  source 1..1155: mol_type = other RNA
atgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaag

SEQ ID NO: 1370 - RNA, 1173 nt, synthetic construct
  misc_feature 1..1173: note = derived and/or modified CDS sequence (opt1) from DENV-3 Consensus__EdelTM-variant (aa1-391)
  source 1..1173: mol_type = other RNA
atgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaag

SEQ ID NO: 1371 - RNA, 2025 nt, synthetic construct
  misc_feature 1..2025: note = derived and/or modified CDS sequence (opt1) from DENV-3 Consensus__SSc-prME
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1372 - RNA, 2025 nt, synthetic construct
  misc_feature 1..2025: note = derived and/or modified CDS sequence (opt1) from DENV-3 Consensus__SSc-prME(F108S)
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctctccgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1373 - RNA, 2025 nt, synthetic construct
  misc_feature 1..2025: note = derived and/or modified CDS sequence (opt1) from DENV-3 Consensus__SSc-prME(R186L)
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgctgacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1374 - RNA, 2025 nt, synthetic construct
  misc_feature 1..2025: note = derived and/or modified CDS sequence (opt1) from DENV-3 Consensus__SSc-prME(A265T)
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccgggaccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1375 - RNA, 2025 nt, synthetic construct
  misc_feature 1..2025: note = derived and/or modified CDS sequence (opt1) from DENV-3 Consensus__SSc-prMEdelstem_TM-JEV
  source 1..2025: mol_type = other RNA
atgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggcagcaccctggggaaggccttctccaccacgctcaagggcgcccagcgcctggcggccctgggggacaccgcctgggacttcggcagcatcgggggcgtgttcaactccatcggccgggccgtccaccaggtgttcgggggcgccttccgcaccctcttcgggggcatgagctggatcacccaggggctgatgggcgcgctgctcctgtggatgggggtgaacgcccgggaccgctccatcgccctggccttcctcgcgacgggcggcgtcctggtgttcctggccaccaacgtgcacgcctga

SEQ ID NO: 1376 - RNA, 1326 nt, synthetic construct
  misc_feature 1..1326: note = derived and/or modified CDS sequence (opt1) from DENV-3 Consensus__SSm-EdelTM
  source 1..1326: mol_type = other RNA
atgacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtcctga

SEQ ID NO: 1377 - RNA, 2373 nt, synthetic construct
  misc_feature 1..2373: note = derived and/or modified CDS sequence (opt1) from DENV-3 Consensus__C-P2A-SSc-prME
  source 1..2373: mol_type = other RNA
atgaacaaccagcgcaagaagaccggcaagccgagcatcaacatgctgaagcgggtgcgcaaccgggtctccaccgggagccagctcgccaagcgcttctccaagggcctgctgaacgggcagggccccatgaagctcgtgatggccttcatcgcgttcctgcggttcctggccatcccgcccacggccggggtgctcgcccgctggggcaccttcaagaagagcggcgccatcaaggtcctgaaggggttcaagaaggagatctccaacatgctgagcatcatcaacaagcggaagaagaacttcgacctgctcaagctggccggcgacgtggagagcaaccccgggccgaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1378 - RNA, 2037 nt, synthetic construct
  misc_feature 1..2037: note = derived and/or modified CDS sequence (opt1) from DENV-3 Consensus__SSopt-prME
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1379 - RNA, 2037 nt, synthetic construct
  misc_feature 1..2037: note = derived and/or modified CDS sequence (opt1) from DENV-3 Consensus__SSopt-prME(F108S)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcagcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1380 - RNA, 2037 nt, synthetic construct
  misc_feature 1..2037: note = derived and/or modified CDS sequence (opt1) from DENV-3 Consensus__SSopt-prME(H27N)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagaacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1381 - RNA, 2037 nt, synthetic construct
  misc_feature 1..2037: note = derived and/or modified CDS sequence (opt1) from DENV-3 Consensus__SSopt-prME(T76I)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccatccagggcgaggccaccctgccggaggagcaggaccagaactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

SEQ ID NO: 1382 - RNA, 2037 nt, synthetic construct
  misc_feature 1..2037: note = derived and/or modified CDS sequence (opt1) from DENV-3 Consensus__SSopt-prME(N89D)
  source 1..2037: mol_type = other RNA
atgaagcgcaagaagaccagcctgtgcctcatgatgatcctgcccgccgccctggcgttccacctcacctcccgcgacggcgagccgcggatgatcgtggggaagaacgagcgcggcaagagcctgctgttcaagacggcctccgggatcaacatgtgcaccctcatcgccatggacctgggcgagatgtgcgacgacaccgtcacctacaagtgcccccacatcacggaggtggagcccgaggacatcgactgctggtgcaacctgaccagcacctgggtgacctacgggacgtgcaaccaggccggcgagcaccggcgcgacaagcggtccgtcgccctcgcgccccacgtgggcatggggctggacacccgcacccagacctggatgagcgccgagggcgcctggcggcaggtggagaaggtcgagacgtgggccctgcgccacccggggttcaccatcctcgcgctgttcctggcccactacatcggcacctccctcacccagaaggtggtgatcttcatcctgctgatgctcgtcacgcccagcatgaccatgcggtgcgtgggggtgggcaaccgcgacttcgtcgagggcctgtccggggccacctgggtggacgtggtcctggagcacggcgggtgcgtgaccacgatggccaagaacaagcccaccctcgacatcgagctgcagaagaccgaggccacccagctggcgacgctccggaagctgtgcatcgagggcaagatcaccaacatcaccaccgacagccgctgccccacgcagggcgaggccaccctgccggaggagcaggaccaggactacgtgtgcaagcacacctacgtcgaccgggggtggggcaacgggtgcggcctcttcgggaagggctccctggtgacctgcgccaagttccagtgcctggagcccatcgagggcaaggtggtccagtacgagaacctcaagtacacggtgatcatcaccgtgcacaccggggaccagcaccaggtcggcaacgagacccagggggtgacggccgagatcaccccgcaggccagcaccaccgaggcgatcctgcccgagtacggcaccctggggctcgagtgctccccgcgcacgggcctggacttcaacgagatgatcctgctcaccatgaagaacaaggcctggatggtccaccggcagtggttcttcgacctgcccctgccctggaccagcggcgccaccacggagacccccacctggaaccgcaaggagctcctggtgaccttcaagaacgcccacgccaagaagcaggaggtggtcgtgctggggtcccaggagggcgcgatgcacacggccctcaccggggccaccgagatccagaacagcggcgggacctccatcttcgccggccacctgaagtgccggctgaagatggacaagctcgagctgaagggcatgagctacgccatgtgcacgaacaccttcgtgctgaagaaggaggtctccgagacccagcacgggaccatcctgatcaaggtggagtacaagggcgaggacgtgccgtgcaagatccccttcagcacggaggacgggcagggcaaggcgcacaacggccgcctcatcaccgccaaccccgtcgtgaccaagaaggaggagcccgtgaacatcgaggccgagccgcccttcggggagagcaacatcgtcatcggcatcggggacaacgccctgaagatcaactggtacaagaagggctccagcatcgggaagatgttcgaggcgaccgcccggggcgcccgccggatggccatcctgggcgacacggcctgggacttcgggtccgtgggcggggtgctcaacagcctgggcaagatggtccaccagatcttcgggtccgcgtacaccgccctgttcagcggcgtgtcctgggtgatgaagatcggcatcggggtcctcctgacctggatcggcctgaacagcaagaacacctccatgagcttctcctgcatcgccatcgggatcatcacgctctacctgggcgccgtggtgcaggcctga

(The sequence listing continues in the following parts.)

The invention claimed is:

1. A pharmaceutical formulation comprising RNA formulated in a lipid nanoparticle (LNP), said RNA comprising
a) at least one coding region encoding at least one polypeptide comprising a yellow fever virus premembrane protein (prM) and a yellow fever virus envelope protein (E), wherein said at least one coding region is at least 90% identical to the RNA sequence of SEQ ID NO: 155; and
b) an untranslated region (UTR) comprising at least one heterologous UTR element, wherein said LNP comprises: (i) at least one cationic lipid; (ii) a neutral lipid; (iii) a sterol;
and (iv) a PEG-lipid.

2. The pharmaceutical formulation according to claim 1, wherein the at least one encoded polypeptide further comprises a yellow fever virus non-structural protein or a flavivirus capsid protein (C).

3. The pharmaceutical formulation according to claim 2, wherein the at least one encoded polypeptide further comprises at least one amino acid sequence that promotes self-cleavage of the encoded polypeptide.

4. The pharmaceutical formulation according to claim 1, wherein the at least one encoded polypeptide comprises at least one signal sequence, wherein the at least one signal sequence is a signal sequence of a secretory protein or a signal sequence of a membrane protein.

5. The pharmaceutical formulation according to claim 1, wherein the at least one encoded polypeptide further comprises at least one amino acid sequence that promotes virus-like particle (VLP) formation.

6. The pharmaceutical formulation according to claim 5, wherein the amino acid sequence promoting virus-like particle (VLP) formation is from a hepatitis B virus core antigen.

7. The pharmaceutical formulation according to claim 1, wherein the at least one encoded polypeptide further comprises at least one amino acid sequence that promotes antigen clustering.

8. The pharmaceutical formulation according to claim 1, wherein the at least one encoded polypeptide comprises a mutated furin cleavage site.

9. The pharmaceutical formulation according to claim 1, wherein the RNA is an mRNA.

10. The pharmaceutical formulation according to claim 1, further comprising a histone stem-loop, a 3'-UTR element, a 5'-UTR element, a poly (A) sequence, and/or a poly(C) sequence.

11. The pharmaceutical formulation according to claim 1, wherein the coding region encodes a polypeptide comprising a sequence that is at least 95% identical to the amino acid sequence of SEQ ID NO: 51.

12. The pharmaceutical formulation according to claim 1, wherein the coding region comprises a sequence that is at least 95% identical to the RNA sequence of SEQ ID NO: 155.

13. The pharmaceutical formulation according to claim 1, wherein the LNP comprises (i) the cationic lipid; (ii) the neutral lipid; (iii) the sterol; and (iv) the PEG-lipid, in a molar ratio of about 20-60% cationic lipid: 5-25% neutral lipid: 25-55% sterol; and 0.5-15% PEG-lipid.

14. The pharmaceutical formulation according to claim 13, wherein the PEG-lipid is PEG-DMG or PEG-cDMA.

15. A kit or kit of parts comprising the pharmaceutical formulation according to claim 1, and comprising technical instructions providing information on administration and dosage of the components.

16. A method for treating or preventing a yellow fever virus infection comprising administering the pharmaceutical formulation of claim 1 to a patient in need thereof.

17. The method of claim 16, wherein the composition is administered by intramuscular injection.

18. A pharmaceutical formulation comprising RNA formulated in a lipid nanoparticle (LNP), said RNA comprising
    a) a 5' Cap;
    b) a 5' untranslated region (UTR);
    c) at least one coding region encoding a polypeptide comprising a sequence that is at least 95% identical to the amino acid sequence of SEQ ID NO: 51, wherein said at least one coding region is at least 90% identical to the RNA sequence of SEQ ID NO: 155;
    d) a 3' UTR; and
    e) a poly(A) sequence,
    wherein said LNP comprises: (i) at least one cationic lipid; (ii) a neutral lipid; (iii) a sterol; and (iv) a PEG-lipid.

19. A method of inducing an anti-Yellow fever virus (YFV) immune response in a mammalian subject comprising administering to the subject a pharmaceutical formulation of claim 18, wherein the pharmaceutical formulation is administered by injection and wherein upon administration the pharmaceutical formulation induces a YFV neutralizing antibody response in the subject.

\* \* \* \* \*